United States Patent
Bhatia et al.

(10) Patent No.: US 12,251,450 B2
(45) Date of Patent: Mar. 18, 2025

(54) DELIVERY, USE AND THERAPEUTIC APPLICATIONS OF THE CRISPR-CAS SYSTEMS AND COMPOSITIONS FOR HBV AND VIRAL DISEASES AND DISORDERS

(71) Applicants: The Broad Institute, Inc., Cambridge, MA (US); Massachusetts Institute of Technology, Cambridge, MA (US); The Rockefeller University, New York, NY (US)

(72) Inventors: Sangeeta Bhatia, Cambridge, MA (US); Charles Rice, New York, NY (US); Feng Zhang, Cambridge, MA (US); David Benjamin Turitz Cox, Cambridge, MA (US); Vyas Ramanan, Cambridge, MA (US); Robert Schwartz, Cambridge, MA (US); Amir Shlomai, New York, NY (US)

(73) Assignees: THE BROAD INSTITUTE, INC., Cambridge, MA (US); MASSACHUSETTS INSTITUTE OF TECHNOLOGY, Cambridge, MA (US); THE ROCKEFELLER UNIVERSITY, New York, NY (US)

( * ) Notice: Subject to any disclaimer, the term of this patent is extended or adjusted under 35 U.S.C. 154(b) by 1179 days.

(21) Appl. No.: 17/002,262

(22) Filed: Aug. 25, 2020

(65) Prior Publication Data
US 2020/0389425 A1    Dec. 10, 2020

Related U.S. Application Data

(63) Continuation of application No. 15/179,938, filed on Jun. 10, 2016, now abandoned, which is a (Continued)

(51) Int. Cl.
| | | |
|---|---|---|
| *A61K 48/00* | (2006.01) | |
| *A61K 38/46* | (2006.01) | |
| *C12N 9/22* | (2006.01) | |
| *C12N 15/01* | (2006.01) | |
| *C12N 15/10* | (2006.01) | |
| *C12N 15/113* | (2010.01) | |
| *C12N 15/63* | (2006.01) | |
| *G06Q 50/00* | (2024.01) | |
| *H04L 51/52* | (2022.01) | |
| *H04L 65/1069* | (2022.01) | |

(Continued)

(52) U.S. Cl.
CPC .......... *A61K 48/005* (2013.01); *A61K 38/465* (2013.01); *C12N 9/22* (2013.01); *C12N 15/01* (2013.01); *C12N 15/102* (2013.01); *C12N 15/113* (2013.01); *C12N 15/63* (2013.01); *G06Q 50/01* (2013.01); *H04L 51/52* (2022.05); *H04L 65/1069* (2013.01); *H04L 67/306* (2013.01); *H04L 67/53* (2022.05); *C07K 2319/09* (2013.01); *C12N 2310/20* (2017.05); *C12N 2740/16043* (2013.01); *C12N 2750/14143* (2013.01)

(58) Field of Classification Search
CPC .... A61K 48/005; A61K 38/465; A61K 38/43; A61K 48/00; C12N 9/22; C12N 15/01; C12N 15/102; C12N 15/113; C12N 15/63; C12N 2310/20; C12N 2740/16043; C12N 2750/14143; C12N 15/1082; C12N 15/86; G06Q 50/01; H04L 51/52; H04L 65/1069; H04L 67/306; H04L 67/53; C07K 2319/09; Y02A 50/30; A61P 31/12; A61P 31/20; A61P 31/22

See application file for complete search history.

(56) References Cited

U.S. PATENT DOCUMENTS

| | | |
|---|---|---|
| 5,622,856 A | 4/1997 | Natsoulis |
| 6,251,677 B1 | 6/2001 | Wilson et al. |

(Continued)

FOREIGN PATENT DOCUMENTS

| | | |
|---|---|---|
| BR | 112015013784 | 7/2017 |
| CA | 2619833 A1 | 3/2007 |

(Continued)

OTHER PUBLICATIONS

Bachman et al., "Dnmt3a and Dnmt3b Are Transcriptional Repressors That Exhibit Unique Localization Properties to Heterochromatin," the Journal of Biological Chemistry, Aug. 24, 2001, vol. 276, No. 34, (pp. 32282-32287).

(Continued)

*Primary Examiner* — Nancy J Leith
(74) *Attorney, Agent, or Firm* — FOLEY & LARDNER LLP

(57) ABSTRACT

The invention provides for delivery, engineering and optimization of systems, methods, and compositions for manipulation of sequences and/or activities of target sequences. Provided are delivery systems and tissues or organ which are targeted as sites for delivery. Also provided are vectors and vector systems some of which encode one or more components of a CRISPR complex, as well as methods for the design and use of such vectors. Also provided are methods of directing CRISPR complex formation in eukaryotic cells to ensure enhanced specificity for target recognition and avoidance of toxicity and to edit or modify a target site in a genomic locus of interest to alter or improve the status of a disease or a condition.

22 Claims, 110 Drawing Sheets
Specification includes a Sequence Listing.

Related U.S. Application Data continuation-in-part of application No. PCT/US2014/070135, filed on Dec. 12, 2014.

(60) Provisional application No. 62/010,329, filed on Jun. 10, 2014, provisional application No. 61/915,301, filed on Dec. 12, 2013.

(51) Int. Cl.
*H04L 67/306* (2022.01)
*H04L 67/53* (2022.01)

(56) References Cited

U.S. PATENT DOCUMENTS

| | | |
|---|---|---|
| 7,601,492 B2 | 10/2009 | Fu et al. |
| 7,691,995 B2 | 4/2010 | Zamore et al. |
| 8,697,359 B1 | 4/2014 | Zhang |
| 8,771,945 B1 | 7/2014 | Zhang |
| 8,865,406 B2 | 10/2014 | Zhang et al. |
| 8,871,445 B2 | 10/2014 | Cong et al. |
| 8,889,418 B2 | 11/2014 | Zhang et al. |
| 8,895,308 B1 | 11/2014 | Zhang et al. |
| 8,932,814 B2 | 1/2015 | Cong et al. |
| 8,945,839 B2 | 2/2015 | Zhang |
| 8,993,233 B2 | 3/2015 | Zhang et al. |
| 9,512,446 B1 | 12/2016 | Joung et al. |
| 9,549,901 B2 | 1/2017 | Shi et al. |
| 9,597,357 B2 | 3/2017 | Gregory et al. |
| 9,623,071 B2 | 4/2017 | Guo et al. |
| 9,637,739 B2 | 5/2017 | Siksnys et al. |
| 9,701,964 B2 | 7/2017 | Clube et al. |
| 9,738,908 B2 | 8/2017 | Wu |
| 9,834,791 B2 | 12/2017 | Zhang et al. |
| 9,873,894 B2 | 1/2018 | Conway et al. |
| 9,926,546 B2 | 3/2018 | Joung et al. |
| 10,190,137 B2 | 1/2019 | Zhang et al. |
| 10,301,651 B2 | 5/2019 | Doudna et al. |
| 10,494,621 B2 | 12/2019 | Zhang et al. |
| 10,583,203 B2 | 3/2020 | De Fougerolles et al. |
| 10,640,788 B2 * | 5/2020 | Zhang ............... C12N 15/1137 |
| 10,660,943 B2 | 5/2020 | Bikard et al. |
| 10,669,557 B2 | 6/2020 | Guschin et al. |
| 10,781,444 B2 | 9/2020 | Zhang et al. |
| 10,851,357 B2 | 12/2020 | Davidson et al. |
| 10,876,100 B2 * | 12/2020 | Zhang ................. C12N 15/902 |
| 10,930,367 B2 | 2/2021 | Zhang et al. |
| 10,941,395 B2 | 3/2021 | Yin |
| 11,116,729 B2 | 9/2021 | Dahlman |
| 11,124,796 B2 | 9/2021 | Sharp |
| 11,390,887 B2 * | 7/2022 | Zhang .................. C12N 15/111 |
| 11,559,588 B2 | 1/2023 | Lundberg et al. |
| 11,578,312 B2 * | 2/2023 | Zhang .................. C12N 15/102 |
| 2003/0186238 A1 | 10/2003 | Allawi et al. |
| 2004/0111221 A1 | 6/2004 | Beattie et al. |
| 2005/0196851 A1 | 9/2005 | Uckun |
| 2005/0220796 A1 | 10/2005 | Dynan et al. |
| 2006/0178297 A1 | 8/2006 | Troy et al. |
| 2006/0234247 A1 | 10/2006 | Puttaraju et al. |
| 2007/0016012 A1 | 1/2007 | Hartlep et al. |
| 2007/0244031 A1 | 10/2007 | Lu et al. |
| 2008/0293655 A1 | 11/2008 | Aygun et al. |
| 2009/0215169 A1 | 8/2009 | Wandless et al. |
| 2010/0055798 A1 | 3/2010 | Battersby |
| 2010/0076057 A1 | 3/2010 | Sontheimer et al. |
| 2010/0081707 A1 | 4/2010 | Ali et al. |
| 2010/0093617 A1 | 4/2010 | Barrangou et al. |
| 2010/0233084 A1 | 9/2010 | Narasimhaswamy et al. |
| 2011/0016540 A1 | 1/2011 | Weinstein et al. |
| 2011/0059502 A1 | 3/2011 | Chalasani |
| 2011/0189776 A1 | 8/2011 | Terns et al. |
| 2011/0223638 A1 | 9/2011 | Wiedenheft et al. |
| 2011/0239315 A1 | 9/2011 | Bonas et al. |
| 2012/0029891 A1 | 2/2012 | Behlke et al. |
| 2013/0096182 A1 | 4/2013 | Chatterjee et al. |
| 2013/0130248 A1 | 5/2013 | Haurwitz et al. |
| 2013/0315831 A1 | 11/2013 | Shi et al. |
| 2014/0068797 A1 | 3/2014 | Doudna et al. |
| 2014/0294771 A1 | 10/2014 | Schaffer et al. |
| 2014/0295557 A1 | 10/2014 | Joung et al. |
| 2014/0315985 A1 | 10/2014 | May et al. |
| 2014/0342456 A1 | 11/2014 | Mali et al. |
| 2014/0356956 A1 | 12/2014 | Church et al. |
| 2014/0357530 A1 | 12/2014 | Zhang et al. |
| 2015/0045546 A1 | 2/2015 | Siksnys et al. |
| 2015/0071899 A1 | 3/2015 | Liu et al. |
| 2015/0071903 A1 | 3/2015 | Liu et al. |
| 2015/0071906 A1 | 3/2015 | Liu et al. |
| 2015/0232881 A1 | 8/2015 | Glucksmann et al. |
| 2015/0247150 A1 | 9/2015 | Zhang et al. |
| 2015/0291965 A1 | 10/2015 | Zhang et al. |
| 2015/0322457 A1 | 11/2015 | Kim et al. |
| 2015/0353905 A1 | 12/2015 | Weiss et al. |
| 2016/0017366 A1 | 1/2016 | Chen et al. |
| 2016/0024510 A1 | 1/2016 | Bikard et al. |
| 2016/0024524 A1 | 1/2016 | Joung et al. |
| 2016/0130609 A1 | 5/2016 | Doudna et al. |
| 2016/0237456 A1 | 8/2016 | Church et al. |
| 2016/0251648 A1 | 9/2016 | Wang et al. |
| 2016/0281072 A1 | 9/2016 | Zhang |
| 2016/0298135 A1 | 10/2016 | Chen et al. |
| 2016/0298137 A1 | 10/2016 | Chen et al. |
| 2016/0312199 A1 | 10/2016 | Joung et al. |
| 2016/0324938 A1 | 11/2016 | Bikard et al. |
| 2016/0340662 A1 | 11/2016 | Zhang et al. |
| 2017/0175144 A1 | 6/2017 | Zhang et al. |
| 2017/0191082 A1 | 7/2017 | Chen et al. |
| 2017/0327806 A1 | 11/2017 | Joung et al. |
| 2018/0127783 A1 | 5/2018 | Zhang et al. |
| 2018/0230495 A1 | 8/2018 | Doudna et al. |
| 2019/0010471 A1 | 1/2019 | Zhang et al. |
| 2020/0282026 A1 | 9/2020 | Bikard et al. |
| 2020/0282027 A1 | 9/2020 | Bikard et al. |
| 2021/0060140 A1 | 3/2021 | Bikard et al. |
| 2021/0060141 A1 | 3/2021 | Bikard et al. |
| 2022/0273566 A1 | 9/2022 | Dahlman |

FOREIGN PATENT DOCUMENTS

| | | |
|---|---|---|
| CN | 101228176 | 7/2008 |
| CN | 103343120 | 10/2013 |
| CN | 103388006 | 11/2013 |
| CN | 103668472 | 3/2014 |
| CN | 104520429 A | 4/2015 |
| CN | 104854241 A | 8/2015 |
| CN | 107532161 A | 1/2018 |
| EP | 2 591 770 A2 | 5/2013 |
| EP | 2 784 162 | 1/2014 |
| EP | 2 764 103 | 8/2014 |
| EP | 2 771 468 | 9/2014 |
| EP | 2 828 386 A1 | 1/2015 |
| FR | 2872170 A1 | 12/2005 |
| IN | 49/2015 | 12/2015 |
| JP | 2004-519245 A | 7/2004 |
| JP | 2004-537285 A | 12/2004 |
| JP | 2005-509409 A | 4/2005 |
| JP | 2006-513694 A | 4/2006 |
| JP | 2006-518996 A | 8/2006 |
| JP | 2007-501626 A | 2/2007 |
| JP | 2009-502170 A | 1/2009 |
| JP | 2009-536827 A | 10/2009 |
| JP | 2010-507680 A | 3/2010 |
| JP | 2010-522547 A | 7/2010 |
| JP | 2012-506254 A | 3/2012 |
| JP | 2012-508235 | 4/2012 |
| JP | 2012-510812 A | 5/2012 |
| JP | 2012-511332 A | 5/2012 |
| JP | 2012-523234 A | 10/2012 |
| JP | 2012-529287 A | 11/2012 |
| JP | 2013-500045 A | 1/2013 |
| JP | 2013-513389 A | 4/2013 |
| JP | 2013-518602 A | 5/2013 |
| JP | 2013-544077 A | 12/2013 |
| JP | 2014-526279 A | 10/2014 |
| JP | 2015-523856 A | 8/2015 |

(56) References Cited

FOREIGN PATENT DOCUMENTS

| | | |
|---|---|---|
| JP | 2016-500003 A | 1/2016 |
| JP | 2016-500262 A | 1/2016 |
| JP | 2016-501531 | 1/2016 |
| JP | 2016-501532 A | 1/2016 |
| JP | 2016-025710 A | 2/2016 |
| JP | 2016-502840 A | 2/2016 |
| JP | 2016-504026 A | 2/2016 |
| JP | 2016-505256 A | 2/2016 |
| JP | 2016-093196 | 5/2016 |
| JP | 2016-516169 A | 6/2016 |
| JP | 2016-517954 A | 6/2016 |
| JP | 2016-131404 A | 7/2016 |
| JP | 2016-520317 A | 7/2016 |
| JP | 2016-521554 A | 7/2016 |
| JP | 2016-521975 A | 7/2016 |
| JP | 2016-521995 | 7/2016 |
| JP | 2016-523082 A | 8/2016 |
| JP | 2016-524472 | 8/2016 |
| JP | 2016-182140 A | 10/2016 |
| JP | 2017-501151 A | 1/2017 |
| JP | 2017-501699 | 1/2017 |
| JP | 6395765 | 9/2018 |
| RU | 2009136452 A | 4/2011 |
| WO | WO-02/074968 A1 | 9/2002 |
| WO | WO-02/080851 A2 | 10/2002 |
| WO | WO-03/014318 A2 | 2/2003 |
| WO | WO-03/104414 A2 | 12/2003 |
| WO | WO-2004/029219 A2 | 4/2004 |
| WO | WO-2004/046321 A2 | 6/2004 |
| WO | WO-2004/062618 A2 | 7/2004 |
| WO | WO-2005/014791 | 2/2005 |
| WO | WO-2005/049642 A2 | 6/2005 |
| WO | WO-2007/014275 A2 | 2/2007 |
| WO | WO-2007/134161 A2 | 11/2007 |
| WO | WO-2008/093152 A1 | 8/2008 |
| WO | WO-2008/108989 | 9/2008 |
| WO | WO-2008/116860 A2 | 10/2008 |
| WO | WO-2008/147438 A2 | 12/2008 |
| WO | WO-2010/011961 A2 | 1/2010 |
| WO | WO-2010/048228 A2 | 4/2010 |
| WO | WO-2010/054108 | 5/2010 |
| WO | WO-2010/065123 A1 | 6/2010 |
| WO | WO-2010/068816 A1 | 6/2010 |
| WO | WO-2010/075424 A2 | 7/2010 |
| WO | WO-2010/079430 A1 | 7/2010 |
| WO | WO-2010/118077 A1 | 10/2010 |
| WO | WO-2010/143917 | 12/2010 |
| WO | WO-2011/011767 A1 | 1/2011 |
| WO | WO-2011/016840 A2 | 2/2011 |
| WO | WO-2011/036510 A1 | 3/2011 |
| WO | WO-2011/064736 A1 | 6/2011 |
| WO | WO-2011/072246 A2 | 6/2011 |
| WO | WO-2011/076873 A1 | 6/2011 |
| WO | WO-2011/100058 | 8/2011 |
| WO | WO-2011/146121 A1 | 11/2011 |
| WO | WO-2012/012738 A1 | 1/2012 |
| WO | WO-2012/031205 | 3/2012 |
| WO | WO-2012/051343 A1 | 4/2012 |
| WO | WO-2012/149470 A1 | 11/2012 |
| WO | WO-2012/164565 A1 | 12/2012 |
| WO | WO-2013/044008 A2 | 3/2013 |
| WO | WO-2013/052681 | 4/2013 |
| WO | WO-2013/5052681 A1 | 4/2013 |
| WO | WO-2013/071440 A1 | 5/2013 |
| WO | WO-2013/078400 A1 | 5/2013 |
| WO | WO-2013/082519 A2 | 6/2013 |
| WO | WO-2013/098244 | 7/2013 |
| WO | WO-2013/130824 A1 | 9/2013 |
| WO | WO-2013/141680 A1 | 9/2013 |
| WO | WO-2013/142578 A1 | 9/2013 |
| WO | WO-2013/155572 | 10/2013 |
| WO | WO-2013/176772 A1 | 11/2013 |
| WO | WO-2014/165349 A1 | 3/2014 |
| WO | WO-2014/065596 A1 | 5/2014 |
| WO | WO-2014/089290 A1 | 6/2014 |
| WO | WO-2014/093479 | 6/2014 |
| WO | WO-2014/093595 | 6/2014 |
| WO | WO-2014/093622 A2 | 6/2014 |
| WO | WO-2014/093635 A1 | 6/2014 |
| WO | WO-2014/093655 | 6/2014 |
| WO | WO-2014/093661 | 6/2014 |
| WO | WO-2014/093694 A1 | 6/2014 |
| WO | WO-2014/093701 A1 | 6/2014 |
| WO | WO-2014/093709 | 6/2014 |
| WO | WO-2014/093712 A1 | 6/2014 |
| WO | WO-2014/093718 | 6/2014 |
| WO | WO-2014/099744 | 6/2014 |
| WO | WO-2014/099750 A2 | 6/2014 |
| WO | WO-2015/031775 | 8/2014 |
| WO | WO-2014/144761 A2 | 9/2014 |
| WO | WO-2014/165825 A2 | 10/2014 |
| WO | WO-2014/186585 A2 | 11/2014 |
| WO | WO-2014/191518 A1 | 12/2014 |
| WO | WO-2014/197568 A2 | 12/2014 |
| WO | WO-2014/197748 A2 | 12/2014 |
| WO | WO-2014/204724 A1 | 12/2014 |
| WO | WO-2014/204725 | 12/2014 |
| WO | WO-2014/204726 A1 | 12/2014 |
| WO | WO-2014/204727 A1 | 12/2014 |
| WO | WO-2014/204728 | 12/2014 |
| WO | WO-2014/204729 A1 | 12/2014 |
| WO | WO-2015/006747 A2 | 1/2015 |
| WO | WO-2015/035136 A2 | 3/2015 |
| WO | WO-2015/048577 | 4/2015 |
| WO | WO-2015/048690 A1 | 4/2015 |
| WO | WO-2015/065964 A1 | 5/2015 |
| WO | WO-2015/070083 A1 | 5/2015 |
| WO | WO-2015/071474 A2 | 5/2015 |
| WO | WO-2015/089351 A1 | 6/2015 |
| WO | WO-2015/089364 | 6/2015 |
| WO | WO-2015/089419 A2 | 6/2015 |
| WO | WO-2015/089427 A1 | 6/2015 |
| WO | WO-2015/113063 A1 | 7/2015 |
| WO | WO-2016/022866 A1 | 2/2016 |
| WO | WO-2016/073955 A2 | 5/2016 |
| WO | WO-2016/141224 A1 | 9/2016 |

OTHER PUBLICATIONS

Brief of Amici Curiae Scientists in Support of Appellants and Reversal; Case: 22-1594; Document: 18; Nos. 22-1594, 22-1653; Filed: Oct. 7, 2022 (24 pages).
Corrected Opening Brief for Cross-Appellants; Appeal Nos. 2022-1594, 2022-1653; Document: 31; Filed: Feb. 15, 2023 (111 pages).
Finn et al., "A Single Administration of CRISPR/Cas9 Lipid Nanoparticles Achieves Robust and Persistent In Vivo Genome Editing," Cell Reports, Cell Press, 2018, vol. 22 (pp. 2227-2235).
Johnson et al., "Achromatopsia caused by novel mutations in both CNGA3 and CNGB3," Journal of Medical Genetics, Online mutation report, Feb. 2004, vol. 41, No. 2 (5 pages).
Love et al., "Lipid-like materials for low-dose, in vivo gene silencing," Proceedings of the National Academy of Sciences, Feb. 2, 2010, vol. 107, No. 5 (pp. 1864-1869).
Mao et al., "Long-Term Rescue of Retinal Structure and Function by Rhodopsin RNA Replacement with a Single Adeno-Associated Viral Vector in P23H RHO Transgenic Mice," Human Gene Therapy, Apr. 2012, vol. 23 (pp. 356-366).
Motion of Regeneron Pharmaceuticals, Inc. For Leave to File a Brief as Amicus Curiae in Support of Appellants and Reversal; Case: 22-1594; Document: 22-1; Nos. 22-1594 and 22-1653; Filed: Oct. 7, 2022 (29 pages).
Opening Brief for Appellants The Regents of the University of California, University of Vienna, Emmanuelle Charpentier; Nos. 2022-1594 & 2022-1653; Case: 22-1594 Document: 17-1 Filed, Sep. 30, 2022 (81 pages).
Patent Interference No. 106, 115; Decision on Motions 37 C.F.R. Section 41.125(a); Filed: Sep. 10, 2020 (113 pages).
Patent Interference No. 106,115; Decision on Priority 37 C.F.R. Section 41.125(a), Filed: Feb. 28, 2022 (84 pages).
Patent Interference No. 106,126; Decision on Motions 37 C.F.R. Section 125(a); Filed: Sep. 28, 2022 (54 pages).

(56) References Cited

OTHER PUBLICATIONS

Patent Interference No. 106,133; Decision on Motions 37 C.F.R. Section 41.125(a) Filed: Dec. 14, 2022 (40 pages).
Semple et al., "Rational design of cationic lipids for siRNA delivery," Nature Biotechnology, Feb. 2010, vol. 28, No. 2 (pp. 172-178).
"Crispr Genome Engineering Resources" XP055167591, Oct. 5, 2013, https://web.archive.org/web/2013100500 [retrieved on Feb. 5, 2015].
"Fixes, extra genomes, and improvements to the CRISPR Design Tool" Google Groups, XP055167583, Oct. 21, 2013, URL:https://groups.google.com/forum/#!topic/crispr/g9Q8U1tNSis [retrieved on Feb. 5, 2015].
"The CRISPR Revolution," Catalyst Magazine, College of Chemistry, University of California, Berkeley, http://catalyst.berkeley.edu/slideshow/the-crispr-revolution/[Dec. 19, 2014 12:40:53] (Jul. 9, 2014).
A. Amsterdam et al., "Identification of 315 genes essential for early zebrafish development," proc Natl Acad Sci., vol. 101, Aug. 31, 2004, pp. 12792-12797, 6 pages.
A. Fire et al., "Potent and specific genetic interference by double-stranded RNA in Caenorhabditis elegans," Nature, vol. 391, Feb. 19, 1998, pp. 806-811, 6 pages.
A. Subramanian et al., "Gene set enrichment analysis: a knowledge-based approach for interpreting genome-wide expression profiles," Proc Natl Acad Sci., vol. 102, Oct. 25, 2005, pp. 15545-15550, 6 pages.
A.C. Spradling et al., "The Berkeley *Drosophila* Genome Project Gene Disruption Project: Single P-Element Insertions Mutating 25% of Vital *Drosophila* Genes," Genetics, vol. 153, Sep. 1999, pp. 135-177, 43 pages.
A.H. Tong et al., "Global mapping of the yeast genetic interaction network," Science, vol. 303, Feb. 6, 2004, pp. 808-813, 6 pages.
A.L. Lin and D.H Gutmann, "Advances in the treatment of neurofibromatosis-associated tumours," Nature, vol. 10, Nov. 2013, pp. 616-624, 9 pages.
A.P. Blanchard and L. Hood, "Sequence to array: probing the genome's secrets," Nat Biotechnol, vol. 14, Dec. 14, 1996, p. 1649.
Abudayyeh, et al., "C2c2 is a single-component programmable RNA-guided RNA-targeting CRISPR effector," Science, vol. 10, Jun. 2, 2016, pp. 1-16, 18 pages.
Addgene Materials, "CRISPR/cas Plasmids and Resources", downloaded from https://www.addgene.org/crispr/, May 6, 2015, 3 pages.
Addgene Materials, "Engineering with Addgene's Help", Addgene Newsletter, Mar. 2013, downloaded from https://archive.constantcontact.com/fs126/1103481513180/archive/1112756362265.html, Oct. 14, 2014, 4 pages.
Addgene Reagent distribution list for Zhang Lab with Plasmid Name, date unknown (prior to May 10, 2015), 2 pages.
Addgene, "gRNA_Cloning Vector", retrieved on Jan. 30, 2019, <https://www/addgenen.org/41824/> 2 pages.
Al-Attar, et al., "Clustered regularly interspaced short palindromic repeats (CRISPRs): the hallmark of an ingenious antiviral defense mechanism in prokaryotes" Biol Chem., vol. 392, No. 4, Apr. 2011, pp. 277-289, 13 pages.
Alberts, et al., "Intracellular Compartments and Protein Sorting," Garland Science, 4 ed., 2002, pp. 671-676, 8 pages.
Allen, et al., "Liposomal drug delivery systems: From concept to clinical applications" Advanced Drug Delivery Reviews, vol. 65, 2013, pp. 36-48, 13 pages.
Andreas, et al., "Enhanced efficiency through nuclear localization signal fusion on phage C31-integrase: activity comparison with Cre and FLPe recombinase in mammalian cells", Nucleic Acids Research, Apr. 15, 2002, vol. 30, No. 11, pp. 2299-2306, 8 pages.
*Arbitron, Inc.* v. *Kiefl*, No. 09-CV-04013 Pac, 2010 WL 3239414, at *1 (S.D.N.Y. Aug. 13, 2010), 7 pages.
Asuri, P., et al., "Directed Evolution of Adeno-Associated Virus for Enhanced Gene Delivery and Gene Targeting in Human Pluripotent Stem Cells," Molecular Therapy, vol. 30, 2012, No. pp. 329-338, 10 pages.

Au, et al., "Characterization of a baculovirus nuclear localization signal domain in the late express factor 3 protein", Virology, vol. 385, 2009, pp. 209-217.
Ausubel, et al. "Compendium of Methods from Current Protocols in Molecular Biology", Short Protocols in Molecular Biology, 4 ed., 1999, 9-0, 9-4, 5 pages.
Autofluorescence MIT Flow Cytometry Core Facility (2018), 6 pages.
B. Langmead et al., "Ultrafast and memory-efficient alignment of short DNA sequences to the human genome," Genome biology, vol. 10, Mar. 4, 2009, 10 pages.
B.Langmead and S.L. Salzberg, "Fast gapped-read alignment with Bowtie 2," Nat Meth, vol. 9, 2012, pp. 357-359, 3 pages.
B.Scappini et al., "Changes associated with the development of resistance to imatinib (STI571) in two leukemia cell lines expressing p210 Bcr/Abl protein," Cancer, vol. 100, Apr. 1, 2004, pp. 1459-1471, 13 pages.
B.Sonnichsen et al., "Full-genome RNAi profiling of early embryogenesis in Caenorhabditis elegans," Nature, vol. 434, Mar. 24, 2005, pp. 462-469, 8 pages.
Bae, T. and Schneewind, O. "Allelic replacement in *Staphylococcus aureus* with inducible counter-selection," Plasmid, vol. 55, 2006, pp. 58-63, 6 pages.
Baena-Lopez, L., et al., "Accelerated homologous recombination and subsequent genome modification in Drosophila," Development, vol. 140, 2013, pp. 4818-4835, including Supplementary Material, 8 pages.
Baiker, et al. "The Immediate-Early 63 Protein of Varicella-Zoster Virus: Analysis of Functional Domains Required for Replication In Vitro and for T-Cell and Skin Tropism in the SCIDhu Model In Vivo", Journal of Virology, 2004, vol. 78 pp. 1181-1194, 14 pages.
Baker, M., "Gene editing at CRISPR Speed," Nature Biotechnology, vol. 32, 2014, pp. 309-312, 4 pages.
Balboa, et al., "Conditionally Stabilized dCas9 Activator for Controlling Gene Expression in Human Cell Reprogramming and Differentiation. (plus Supplemental Information)", Stem Cell Reports, vol. 5, Sep. 8, 2015, pp. 448-459, 12 pages.
Banaszewska, A., et al., "Proprotein Convertase Subtilisin/Kexin Type 9: A New Target Molecule For Gene Therapy," Cellular & Molecular Biology Letters, vol. 17, 2012, pp. 228-239, 12 pages.
Barrangou and Van Der Oost (Eds.), "CRISPR-Cas Systems," Springer Heidelberg, 2013, pp. i-299.
Barrangou, R. et al., "CRISPR provides acquired resistance against viruses in prokaryotes," Science, vol. 315, Mar. 23, 2007, pp. 1709-1712, 6 pages.
Barrangou, R., "RNA-mediated programmable DNA cleavage," Nature Biotechnology, vol. 30, 2012, pp. 836-388, 13 pages.
Bassett, et al. "Highly Efficient Targeted Mutagenesis of *Drosophila* with the CRISPR/Cas9 System" Cell Reports, vol. 4, Jul. 11, 2013, p. 220.
Bassett, et al., "A Genome-Wide CRISPR Library for High-Throughput Genetic Screening in Drosophila Cells," Journal of Genetics and Genomics, vol. 42, Apr. 18, 2015, pp. 301-309, 9 pages.
Bauer, et al., "An Erythroid Enhancer of BCL11A Subject to Genetic Variation Determines Fetal Hemoglobin Level," Science, vol. 342, Oct. 11, 2013, pp. 253-257, 4 pages.
Beerli, et al. "Positive and negative regulation of endogenous genes by designed transcription factors" PNAS, vol. 97, Feb. 15, 2000, pp. 1495-1500.
Beerli, et al., "Toward controlling gene expression at will: Specific regulation of the erbB-2/HER-2 promoter by using polydactyl zinc finger proteins constructed from modular building blocks", Proc. Natl. Acad. Sci., vol. 95, Oct. 7, 1998, pp. 14628-14633.
Beerli, R., et al., "Engineering polydactyl zinc-finger transcription factors," Nature Biotechnology, vol. 20, Feb. 2002, pp. 135-141.
Bennett, et al., "Stable transgene expression in rod photoreceptors after recombinant adeno-associated virus-mediated gene transfer to monkey retina", Proc. Natl. Acad. Sci., vol. 96, Aug. 1999, pp. 9920-9925.
Bergemann, et al., Excision of specific DNA-sequences from integrated retroviral vectors via site-specific recombination:, Nucleic Acids Res., vol. 23, Oct. 2, 1995, pp. 4451-4456.

(56) References Cited

OTHER PUBLICATIONS

Berns, K., et al., "A Large-Scale RNAi Screen in Human Cells Identifies New Components of the p53 Pathway," Nature, vol. 428, Mar. 25, 2004, pp. 431-437.
Bhaya, D., et al., "CRISPR-Cas Systems in Bacteria and Archaea: Versatile Small RNAs for Adaptive Defense and Regulation," Annual Review of Genetics, vol. 45, 2011, pp. 273-297.
Bikard, et al. "CRISPR Interference Can Prevent Natural Transformation and Virulence Acquisition During In Vivo Bacterial Infection," Cell Host & Microbe, vol. 12, 2012, pp. 177-186.
Bikard, et al., Supplementary Information for: "CRISPR Interference Can Prevent Natural Transformation and Virulence Acquisition During In Vivo Bacterial Infection," Cell Host & Microbe, vol. 12, 2012, pp. 177-186.
Birch, et al., "Plant Transformation: Problems and Strategies for Practical Application", Annu. Rev. Plant Physiol. Plant Mol. Biol., vol. 48, 1997, pp. 297-326.
Bloom, et al., "Inactivation of hepatitis B virus replication in cultured cells and in vivo with engineered transcription activator-like effector nucleases", Molecular Therapy, vol. 21, Oct. 2013, pp. 1889-1897.
Bobis-Wozowicz, S., et al., "Targeted genome editing in pluripotent stem cells using zinc-finger nucleases," Methods, vol. 53, 2012, pp. 339-346.
Boch, et al., "Breaking the Code of DNA Binding Specificity of TAL-Type III Effectors". Science, vol. 326, 2009, pp. 1509-1512.
Boch, et al., "Xanthomonas AvrBs3 Family-Type III Effectors: Discovery And Function", Annu. Rev. Phytopathol, vol. 48, 2010, pp. 419-436.
Boden, et al., "Efficient Gene Transfer of HIV-1-Specific Short Hairpin RNA into Human Lymphocytic Cells Using Recombinant Adeno-associated Virus Vectors", Molecular Therapy, vol. 9, 2004, pp. 396-402.
Bogdanove, et al., "TAL Effectors: Customizable Proteins for DNA Targeting", Science, vol. 333, 2011, pp. 1843-1846.
Bohm et al., "The computer program Ludi: A new method for the de novo design of enzyme inhibitors", Journal of Computer-Aided Molecular Design, vol. 6, 1992, pp. 61-78.
Botta, S. et al., "Transcriptional Repression with Zinc-Finger and Tale Protein Scaffold", Molecular Therapy, 2013, Supplement 1, p. S208, Abstract No. 539.
Bouard, et al., "Themed Section: Vector Design and Drug Delivery Review, Viral vectors: from virology to transgene expression", British Journal of Pharmacology, vol. 157, 2009, pp. 153-165.
Boutros, et al., "Genome-wide RNAi analysis of growth and viability in *Drosophila* cells," Science, American Association for the Advancement of Science, vol. 303, Feb. 6, 2004, pp. 832-835.
Branden, C., and Tooze, J., "Prediction, Engineering, and Design of Protein Structures: Introduction to Protein Structure," Garland Publishing, Inc., Chapter 16, 1991, p. 247.
Briner, et al., "Guide RNA Functional Modules Direct Cas9 Activity and Orthogonality", Molecular Cell, vol. 56, 2014, pp. 333-339.
Brouns, S., "A Swiss Army Knife of Immunity," Science, vol. 337, 2012, pp. 808-809.
Brouns, S., et al., "Small CRISPR RNAs Guide Antiviral Defense in Prokaryotes," Science, vol. 321, Aug. 15, 2008, pp. 960-964.
Brummelkamp Tr et al., "A system for stable expression of short interfering RNAs in mammalian cells," Science, vol. 296, Apr. 19, 2002, pp. 550-553.
C. Cayrol et al., "The THAP-zinc finger protein THAP1 regulates endothelial cell proliferation through modulation of pRB/E2F cell-cycle target genes," Blood, vol. 109, 2007, pp. 584-594.
C. Trapnell et al., "Differential gene and transcript expression analysis of RNA-seq experiments with TopHat and Cufflinks," Nature protocols, vol. 7, 2012, p. 562.
C. Trapnell et al., "TopHat: discovering splice junctions with RNA-Seq.," Bioinformatics, vol. 25, 2009, pp. 1105-1111.
C.J, Echeverri et al., "Minimizing the risk of reporting false positives in large-scale RNAi screens," Nature methods, vol. 3, Oct. 2006, p. 777.

C.M Johannessen et al., "COT drives resistance to RAF inhibition through MAP kinase pathway reactivation," Nature, vol. 468, Dec. 16, 2010, p. 968.
C.M. Johnston et al., "Large-scale population study of human cell lines indicate that dosage compensation is virtually complete," PLoS Genet., vol. 4, Jan. 2008, pp. 88-98, 11 pages.
Campeau, et al., "A Versatile Viral System for Expression and Depletion of Proteins in Mammalian Cells", PLoS One, vol. 4, 2009, pp. 1-17.
Canver, et al., "BCL11A enhancer dissection by Cas9-mediated in situ saturating mutagenesis," Nature, vol. 527, 2015, pp. 192-197, including Supplementary Material.
Carr, et al., "Genome engineering", Nature Biotechnology, vol. 27, 2009, pp. 1151-1162.
Carroll, D., "A Crispr Approach to Gene Targeting," Molecular Therapy, vol. 20, 2012, pp. 1658-1660.
Carroll., "Genome Engineering With Zing-Finger Nucleases", Genetics, vol. 188, 2011, pp. 773-782.
Carroll., "Progress and prospects: Zinc-finger nucleases as gene therapy agents", Gene Therapy, vol. 15, 2008, pp. 1463-1468.
Carte, J., et al., "Cas6 is an endoribonuclease that generates guide RNAs for invader defense in prokaryotes," Genes Dev., vol. 22, 2008, pp. 3489-3496.
Cermak, T., et al., "Efficient design and assembly of custom TALEN and other TAL Effector-Based Constructs For DNA Targeting", Nucleic Acids Research, vol. 39, 2011, pp. 1-11.
Chadderton, N., et al., "Improved Retinal Function in a Mouse Model of Dominant Retinitis Pigmentosa Following AAV-delivered Gene Therapy", Molecular Therapy, vol. 17, Apr. 2009, pp. 593-599.
Chan, et al. "Characterization of the Kinetochore Binding Domain of CENP-E Reveals Interactions with the Kinetochore Proteins CENP-F and hBuBR1", The Journal of Cell Biology, vol. 143, 1998, pp. 49-63.
Chan, Wai-Ting, et al., "Toxin-Antitoxin Genes of the Gram-Positive Pathogen *Streptococcus pneumoniae*: So Few and Yet So Many", Microbiology and Molecular Biology Reviews, vol. 76, 2012, pp. 773-791.
Chang, N., et al. "Genome editing with RNA-guided Cas9 nuclease in Zebrafish embryos", Cell Research, vol. 23, 2013, pp. 465-472.
Chen, B., et al., "Dynamic Imaging of Genomic Loci in Living Human Cells by an Optimized CRISPR/Cas System," Cell, vol. 155, 2013, pp. 1479-1491.
Chen, Fuqiang, et al., "High-frequency genome editing using ssDNA oligonucleotides with zinc-finger nucleases". Nature Methods, 2011, vol. 8, pp. 753-755, including Supplemental Online Methods.
Chen, Jieliang, et al., "An Efficient Antiviral Strategy for Targeting Hepatitis B Virus Genome Using Transcription Activator-Like Effector Nucelases", Molecular Therapy, vol. 22, 2014, pp. 303-311.
Chen, S., et al., "Genome-wide CRISPR Screen in a Mouse Model of Tumor Growth and Metastasis", Cell, vol. 160, 2015, pp. 1-15, http://dx.doi.org/10.1016/j.cell.2015.02.038.
Chevalier et al., "Homing endonuclease: structural and functional insight into the catalysts of intron/intein mobility," Oxford University Press., vol. 29, 2001, pp. 3757-3774.
Chinnasamy, D., et al., "Multicistronic lentiviral vectors containing the FMCV 2A Cleavage factor demonstrate robust expression of encoded genes at limiting MOI," Virology Journal, vol. 3, 2006, pp. 1-16.
Chiu, et al., "Engineered GFP as a vital reporter in plants", Current Biology, vol. 6, 1996, pp. 325-330.
Cho, A., et al., "Generation of Transgenic Mice," Current Protocols in Cell Biology, Chapter Unit 19.11, 2009, pp. 1-29.
Cho, Minseon, et al., "Quantitative selection and parallel characterization of aptamers," PNAS, vol. 110, Nov. 12, 2013, pp. 18460-18465.
Cho, Seung Woo, et al. "Analysis off-target effects of CRISPR/Cas-derived RNA-guided endonucleases and nickases" Genome Research, vol. 24, 2014, pp. 132-141.
Cho, Seung Woo, et al., "Targeted genome engineering in human cells with the Cas9 RNA-guided endonuclease," Nature Biotechnology, vol. 31 pp. 230-232, including Supplementary Information, 14 pages, 2013.

(56) References Cited

OTHER PUBLICATIONS

Chou, JY, and Mansfield, BC., "Recombinant AAV-directed gene therapy for type I glycogen storage diseases," Expert Opinion on Biological Therapy, vol. 11, Aug. 2011, pp. 1011-1024.
Choulika, et al., "Transfer of Single Gene-Containing Long Terminal Repeats into the Genome of Mammalian Cells by a Retroviral Vector Carrying the cre Gene and the loxP site", Journal of Virology, vol. 70, 1996, pp. 1792-1798.
Christian, et al., "Supporting Information—Targeting DNA Double-Strand Breaks With TAL Effector Nucleases", Genetics, 2010, pp. 1-8, DOI:10.1534/110.120717:1SI-8SI.
Christian, et al., "Targeting DNA Double-Strand Breaks With TAL Effector Nucleases", Genetics, vol. 186, 2010, pp. 757-761.
Chylinski, et al., "Classification and evolution of type II CRISPR-Cas systems", Nucleic Acids Research, vol. 42, 2014, pp. 6091-6105, doi:10.1093lnarlgku241.
Chylinski, K., et al., "The tracrRNA and Cas9 Families of Type II CRISPR-Cas Immunity Systems," RNA Biology, vol. 10, 2013, pp. 726-737.
Clark, K., et al., "A Tale of Two Nucleases: Gene Targeting for the Masses?" Zebrafish, vol. 8, No. 3, 2011, pp. 147-149.
Cockrell, "Berkeley's Wikipedian-in-residence is a first," NewsCenter, Feb. 25, 2014, downloaded from https://newscenter.berkeley.edu/2014/02/25/berkeleys-wikipedian-in-residence-is-a-first/, May 8, 2015, 3 pages.
Community Corner, "CRISPR technology for gene therapy," Nature Medicine, vol. 20, May 2014, pp. 476-477.
Cong, et al., Oct. 5, 2012 Manuscript including Supplementary Materials, "CRISPR-Assisted Mammalian Genome Engineering," published as "Multiplex Genome Engineering Using CRISPR-Cas Systems," Science, vol. 339, 2013, pp. 819-823.
Cong, L., et al., "Comprehensive interrogation of natural TALE DNA-binding modules and transcriptional repressor domains," Nature Communications, vol. 3, Jul. 24, 2012, pp. 968-973.
Cong, L., et al., "In Vivo Genome Engineering With AAV Vector Carrying CRISPR-Cas9 System," Molecular Therapy, vol. 22, May 2014, Supplement 1, p. S214.
Cong, L., et al., "Multiplex Genome Engineering Using CRISPR-Cas Systems," Science, vol. 339, 2013, pp. 819-823.
Cong, L., et al., Supplementary Material for: "Multiplex Genome Engineering Using CRISPR-Cas Systems," Science, vol. 339, 2013, pp. 819-823.
Connor, S., "Scientific split—the human genome breakthrough dividing former colleagues," The Independent, http://www.independent.co.uk/news/science/scientific-split--the-human-genome-breakthrough-dividing-former-colleagues-9300456.html, dated Apr. 25, 2014, 5 pages.
Costantino, et al., "Enhanced levels of alpha Red-mediated recombinants in mismatch repair mutants", PNAS, vol. 100, 2003, pp. 15748-15753.
Cotropia, et al., "Copying in Patent Law," N.C.L. Rev., Stanford Public Law Working Paper No. 1270160, 2009, pp. 1-46.
Cummings et al., "Fourteen and counting: unraveling trinucleotide repeat diseases", Human Molecular Genetics, vol. 9, 2000, pp. 909-916.
D.J.Burgess et al., "Topoisomerase levels determine chemotherapy response in vitro and in vivo," Proceedings of the National Academy of Sciences, vol. 105, Jul. 1, 2008, pp. 9053-9058.
Daboussi, F., et al., "Chromosomal context and epigenetic mechanisms control the efficacy of genome editing by rare-cutting designer endonucleases," Nucleic Acids Research, vol. 40, 2012, pp. 6367-6379.
Dahlman, J., et al., "In vivo endothelial siRNA delivery using polymeric nanoparticles with low molecular weight," Nature Nanotechnology, vol. 9, 2014, pp. 648-655.
Dai, et al. "Genes:Structures and Regulation: The Transcription Factors GATA4 and dHAND Physically Interact to Synergistically Activate Cardiac Gene Expression through a p300- dependent Mechanism", J. Biol. Chem., vol. 277, 2002 pp. 24390-24398.

Daley, J., and Wilson, T., "Rejoining of DNA Double-Strand Breaks as a Function of Overhang Length," Molecular and Cellular Biology, vol. 25, 2005, pp. 896-906.
Damian, M., and Porteus, M., "A Crisper Look at Genome Editing: RNA-guided Genome Modification," Molecular Therapy, vol. 21, Apr. 2013, pp. 720-722.
Database GenBank, "*Staphylococcus aureus* subsp.aureus ORFX gene and pseudo SCCmec-SCC-SCCCRISPR element, strain M06/0171," Accession No. HE980450, http://www.ncbi.nlm.nih.gov/nuccore/HE980450, dated Aug. 18, 2016, 22 pages.
Database GenBank: "CRISPR-associated protein, Csn1 family, *Staphylococcus pseudintermedius* ED99," Accession No. ADX75954, http://www.uniprot.org/uniprot/G1UFN3.txt?version=3, dated Nov. 21, 2011, 1 page.
Database UniProt: "CRISPR-associated endonuclease Cas9: Staphylococcus aureus," UniProtKB, J7RUA5 (CAS9_STAAU), XP002738511M, https://www.uniprot.org/uniprot/J7RUA5#, dated Oct. 31, 2012, 7 pages.
Database UniProtKB/TrEMBL [online], Accession No. Q0P897, "The genome sequence of the food-borne pathogen Campylobacter jejuni reveals hypervariable sequences," Subname: Full=Putative CRISPR-associated protein, Oct. 3, 2012 uploaded, [retrieved on Jul. 22, 2017], URL, http://www.uniprot.org/uniprot/Q0P897.txt?version=28.
Database UniProtKB/TrEMBL, Accession No. D0W2Z9, http://www.uniprot.org/uniprot/DOW2Z9.txt?version=4, dated Oct. 3, 2012, 1 page.
Database UniProtKB/TrEMBL, Accession No. G1UFN3, http://www.uniprot.org/uniprot/G1UFN3.txt?version=3, dated Oct. 3, 2012, 1 page.
Database UniProtKB/TrEMBL, Accession No. J3TRJ9, http://www.uniprot.org/uniprot/J3TRJ9.txt?version=2, dated Oct. 31, 2012, 1 page.
Database UniProtKB/TrEMBL, Accession No. Q6NK13, http://www.uniprot.org/uniprot/Q6NKI3.txt?version=43, dated Jun. 13, 2012, 1 page.
Database UniProtKB/TrEMBL, Accession No. Q73QW6, http://www.uniprot.org/uniprot/Q73QW6.txt?version=4, dated Nov. 28, 2012, 2 pages.
Database WPI, Week 201437 Thomson Scientific, London, GB; AN 2014-J79552, XP-002737563, 2 pages.
Datsenko, et al. "Molecular memory of prior infections activates the CRISPR/Cas adaptive bacterial immunity system", Nature Communications, vol. 3, 2012, pp. 1-7.
Dean., "Recent Advances in Drug Design Methods: Where Will They Lead?", BioEssays, vol. 16, Sep. 1994, pp. 683-687.
Declaration of Feng Zhang for U.S. Appl. No. 14/054,414 dated Jan. 30, 2014 (10 pages).
Declaration of Technical Expert Paul Simons dated Dec. 22, 2015, 76 pages.
Deltcheva, E., et al., "CRISPR RNA maturation by trans-encoded small RNA and host Factor RNase III," Nature, vol. 471, 2011, pp. 602-609.
Deltcheva, et al., "Supplementary Information: CRISPR RNA Maturation By Trans-Encoded Small RNA and Host Factor RNase III" Nature, pp. 1-35 2011.
Deveau, H. et al., "Phage response to CRISPR-encoded resistance in *Streptococcus thermophilus*," Journal of Bacteriology, vol. 190, Feb. 2008, pp. 1390-1400.
Deveau, H., et al., "CRISPR/Cas system and its role in phage-bacteria interactions," Annu. Rev. Microbiol., vol. 64, 2010, pp. 475-493.
Dicarlo, et al., "Genome engineering in *Saccharomyces cerevisiae* using CRISPTR-Cas systems", Nucleic Acids Research, vol. 41, 2013 pp. 4336-4343.
Dingwall, et al. "A Polypeptide Domain That Specifies Migration of Nucleoplasmin into the Nucleus", Cell, vol. 30, 1982, pp. 449-458, (Abstract only).
Dingwall, et al., "The Nucleoplasmin Nuclear Location Sequence is Larger and More Complex than That of SV-40 Large T Antigen", The Journal of Cell Biology, vol. 107, 1988, pp. 841-849.

(56) References Cited

OTHER PUBLICATIONS

Do, et al., "Identification of multiple nuclear localization signals in murine Elf3, an ETS transcription factor" FEBS Letters, vol. 580, 2006, pp. 1865-1871.
Doench, et al., "Rational design of highly active sgRNAs for CRISPR-Cas9-mediated gene inactivation," Nature Biotechnology, vol. 32, 2014, pp. 1262-1267, including Supplementary Material, 17 pages.
Dominguez, et al., "Beyond editing: repurposing CRISPR-Cas 9 for precision genome regulation and interrogation" Nat Rev Mol Cell Biol., vol. 17, 2016, 17 pp. 5-15.
Dong, et al., "The crystal structure of Cpf1 in complex with CRISPR RNA," Nature, vol. 532, 2016, pp. 523-525.
Drittanti, et al. "High throughput production, screening and anyalysis of adeno-associated viral vectors", Gene Therapy, vol. 7, 2000, pp. 924-929.
Dworetzky, S., et al., "The Effects of Variations in the Number and Sequence of Targeting Signals on Nuclear Uptake," The Journal of Cell Biology, vol. 107, 1988, pp. 1279-1287.
E.S. Lander, "Initial impact of the sequencing of the human genome," Nature, vol. 470, Feb. 10, 2011, p. 187-197.
Ebina, H., et al., "Harnessing the CRISPR/Cas9 system to disrupt latent HIV-1 provirus," Scientific Reports, vol. 3, 2013, pp. 1-7.
Edgar, R. and Qimron, U., "The *Escherichia coli* CRISPR system protects from λ lysogenization, lysogens, and prophage induction," Journal of Bacteriology, vol. 192, Dec. 2010, pp. 6291-6294.
Ellis, B., et al., "Zinc-finger nuclease-mediated gene correction using single AAV vector transduction and enhanced by Food and Drug Administration-Approved Drugs," Gene Therapy, vol. 20, 2013, pp. 35-42.
Ellis, et al., "Macromolecular Crowding: Obvious But Underappreciated", TRENDS in Biochemical Sciences, vol. 26, 2001, pp. 597-604.
Ellis, Hilary, et al., "High efficiency mutagenesis, repair, and engineering of chromosomal DNA using single-stranded oligonucleotids" PNAS, vol. 98, 2001, pp. 6742-6746.
Enyeart, et al., "Biotechnological applications of mobile group II introns and their reverse transcriptases: gene targeting, RNA-seq, and non-coding RNA analysis", Mobile DNA, vol. 5, 2014, pp. 1-19 http://www.mobilednajournal.com/contents5/1/2.
Espinoza, et al., "Characterization of the structure, function, and mechanism of B2 RNA, an ncRNA repressor of RNA polymerase II transcription", RNA, vol. 13, 2007, pp. 583-596.
Esvelt et al., "Orthogonal Cas9 proteins for RNA-guided gene regulation and editing", Nature Methods, vol. 10, No. 11, Nov. 2013 (available online Sep. 29, 2013), pp. 1116-1123.
Excerpt from Dr. Feng Zhang's Jan. 30, 2014 Declaration (Exhibit C1), 11 pages.
Federal Circuit decision in *Dow Chemical Co.* v. *Nova Chemicals Corp.*, Appeal Nos. 2014-1431, 2014- 1462 (Fed. Cir. Aug. 28, 2015) (*Dow* v. *Nova*), 25 pages.
Feldgarden et al., "*Staphylococcus aureus* M0408 acrHk-supercont1.1, whole genome shotgun sequence", NCBI Reference Sequence: NK_KB821326.1, Direct Submission, Dec. 10, 2012, pp. 1-4.
Fieck, et al., "Modifications of the *E.coli* Lac repressor for expression in eukaryotic cells: effects of nuclear signal sequences on protein activity and nuclear accumulation", Nucleic Acids Research, vol. 20, 1992, pp. 1785-1791.
Fischer, S. et al., "An archaeal immune system can detect multiple Protospacer Adjacent Motifs (PAMs) to target invader DNA," J. Biol. Chem., vol. 287, Sep. 28, 2012, pp. 33351-33363.
Fischer-Fantuzzi, L., and Vesco, C., "Cell-dependent efficiency of reiterated nuclear signals in a mutant simian virus 40 oncoprotein targeted to the nucleus," Molecular and Cellular Biology, vol. 8, 1988, pp. 5495-5503.
Flannery, J. G., "Ribozyme-Mediated Gene Therapy for Autosomal Dominant Retinal Degeneration", Retinal Degenerative Diseases and Experimental Therapy, 1999, pp. 277-291.
Fleming, J., et al., "Adeno-Associated Virus and Lentivirus Vectors Mediate Efficient and Sustained Transduction of Cultured Mouse and Human Dorsal Root Ganglia Sensory Neurons," Human Gene Therapy, vol. 12, Jan. 1, 2001, pp. 77-86.
Foecking, et al. "Powerful and versatile enhance-promoter unit for mammalian expression vectors", Gene, vol. 45, 1986, pp. 101-105.
Fonfara et al., "Phylogeny of Cas9 determines functional exchangeability of dual-RNA and Cas9 among orthologous type II CRISPR-Cas systems", Nucleic Acids Research, 2014, vol. 42, No. 4, pp. 2577-2590.
Freitas, et al., "Mechanisms and Signals for the Nuclear Import of Proteins", Current Genomics, vol. 10, 2009, pp. 550-557.
Fu, et al., "High-frequency off-target mutagenesis induced by CRISPR-Cas nucleases in human cells", Nature Biotechnology, vol. 31, 2013, pp. 822-826.
Fu, et al., "Targeted genome editing in human cells using CRISPR/Cas nucleases and truncated guide RNAs", The Use of CRISPR/Cas9 ZFNs and Talens in Generating Site-Specific Genome Alterations; Elsivier Inc., 2014, pp. 21-45.
G. Giaever et al., "Functional profiling of the *Saccharomyces cerevisiae* genome," Nature, vol. 418, Jul. 25, 2002, pp. 387-391.
G. Guo et al., "Mismatch repair genes identified using genetic screens in Blm-deficient embryonic stem cells," Nature, vol. 429, Jun. 24, 2004, p. 891.
Gabriel, R., et al., "An unbiased genome-wide analysis of zinc-finger nuclease specificity," Nature Biotechnology, vol. 29, 2011, pp. 816-823.
Gaj, T., et al., "Targeted Gene knockout by direct delivery of zinc-finger nuclease proteins," Nature Methods, vol. 9, 2012, pp. 805-807, including supplemental pages.
Gaj, T., et al., "ZFN, TALEN, and CRISPR/Cas-Based Methods for Genome Engineering," Trends in Biotechnology, vol. 31, 2013, pp. 397-405.
Gama Sosa, M., et al., "Animal transgenesis: an overview," Brain Structure and Function, vol. 214,0 2010, pp. 91-109.
Gao, et al. "Engineered Cpf1 variants with altered PAM specificities", Nature Biotechnology, vol. 35, Jun. 8, 2017, pp. 1-4 (789-792), doi:10.1038/nbt.3900, advanced online publication including Supplementary Information.
Gao, et al., "A Sustained, Cytoplasmic Transgene Expression System delivered by Cationic Liposomes", Biochemical and Biophysical Research Communications, vol. 200, May 16, 1994, pp. 1201-1206.
Garcia-Bustos, et al., "Nuclear protein localization", Biochimica et Biophysica Acta, vol. 1071, 1991, pp. 83-101.
Gardlik, R., et al., "Vectors and delivery systems in gene therapy," Medical Science Monitor, vol. 11, No. 4, pp. RA110-121, dated Apr. 1, 2005, 12 pages.
Garg, et al. "Engineering synthetic TAL effectors with orthogonal target sites", Nucleic Acids Research, 2012, vol. 40, pp. 7584-7595, doi:10.1093/nar/gks404.
Garneau, et al., "The CRISPR-Cas bacterial immune systems cleaves bacteriophage and plasmid DNA", Nature, vol. 468, 2010, pp. 67-71.
Garriga-Canut, M., et al., "Synthetic zinc finger repressors reduce mutant huntingtin expression in the brain of R6/2 mice," Proceedings of the National Academy of Sciences, vol. 109, Oct. 10, 2012, pp. E3136-E3145.
Gasiunas, G, et al., "Cas9-crRNA ribonucleoprotein complex mediates specific DNA cleavage for adaptive immunity in bacteria," Proceedings of the National Academy of Sciences, vol. 109, 2012, p. E2579-2586.
Geibler, et al., "Transcriptional Activators of Human Genes with Programmable DNA-Specificity", PLone, vol. 6, 2011, pp. 1-7 Doi:10.1371/hournal.pone.0019509.
Geisinger, et al., "In vivo blunt-end cloning through CRISPR/CAS9-facilitated non-homologous end-joining", Nucleic Acid Research Advance Access, vol. 44, 2016, pp. 1-15.
GenBank: "CRISPR-associated protein Cas9/Csn1 [*Staphylococcus aureus* subsp. *aureus*]", GenBank: CCK74173.1, Year: 2012, http://www.ncbi.nlm.nih.gov/protein/403411236?sat=16&satkey=13804560, dated Dec. 14, 2016, 2 pages.
Gibson, D.G. et al., "Enzymatic assembly of DNA molecules up to several hundred kilobases," Nat methods, vol. 6, 2009, pp. 343-345.

(56) References Cited

OTHER PUBLICATIONS

Gilbert, L., et al., "CRISPR-Mediated Modular RNA-Guided Regulation of Transcription in Eukaryotes," Cell, vol. 154, 2013, pp. 442-451.
Goldfarb, et al. "Synthetic peptides as nuclear localization signals", Nature, vol. 322, 1986, pp. 641-644.
Gomaa, et al. "Programmable removal of bacterial strains by use of genome-targeting CRISPR-Cas systems", MBio., vol. 5, 2014, pp. 1-9.
Goncalves, M., et al., "Concerted nicking of donor and chromosomal acceptor DNA promotes homology-directed gene targeting in Human Cells," Nucleic Acids Research, vol. 40, 2012, pp. 3443-3455.
Gratz, et al., "Genome Engineering of *Drosophila* with the CRISPR RNA-Guided Cas9 Nuclease", Genetics, vol. 194, 2013, pp. 1029-1035.
Greenspan, et al., "Two Nuclear Location Signals in the Influenza Virus NS1 Nonstructural Protein", Journal of Virology, vol. 62, 1988, pp. 3020-3026.
Greenwald, D L, et al., "Engineered Zinc Finger Nuclease-Mediated Homologous Recombination of the Human Rhodopsin Gene", Investigative Ophthalmology & Visual Science, vol. 51, Dec. 2010, pp. 6374-6380.
Grens, "Enzyme Improves CRISPR A smaller Cas9 protein enables in vivo genome engineering via viral vectors", The Scientist, Apr. 1, 2015.
Grieger, J., and Samulski, R., "Packaging Capacity of Adeno—Associated Virus Serotypes: Impact of Larger Genomes on Infectivity and Postentry Steps," Journal of Virology, vol. 79, 2005, pp. 9933-9944.
Grissa, I., et al., "CRISPRFinder: a web tool to identify clustered regularly interspaced short palindromic repeats," Nucleic Acids Research, vol. 35, 2007, pp. W52-W57.
Grosse, et al. "Meganuclease-medicated Inhibition of HSV1 Infection in Cultured Cells", Molecular Therapy, vol. 19, No. 4, Apr. 1, 2011, pp. 694-702.
Guan, et al., "Heritable endogenous gene regulation in plants with designed polydactyl zinc finger transcription factors", PNAS, vol. 99, 2002, pp. 13296-13301.
Gudbergsdottir, S. et al., "Dynamic properties of the Sulfolobus CRISPR/Cas and CRISPR/Cmr systems when challenged with vector-borne viral and plasmid genes and protospacers," Mol. Microbiology, vol. 79, 2011, pp. 35-49.
Gustafsson, et al. "Codon Bias and heterologous protein expression", Trends in Biotechnology, Jul. 2004, vol. 22, pp. 346-353.
H. Davies et al., "Mutations of the BRAF gene in human cancer," Nature, vol. 417, Jun. 27, 2002, p. 949-954.
H.W Cheung et al., "Systematic investigation of genetic vulnerabilities across cancer cell lines reveals lineage-specific dependencies in ovarian cancer," Proceedings of the National Academy of Sciences, vol. 108, Jul. 26, 2011, p. 12372-12377.
Habib, N., Assignment to Broad Institute, dated Jun. 9, 2014, 4 pages.
Haft, D., et al., "A Guild of 45 CRISPR-Associated (Cas) Protein Families and Multiple CRISPR/Cas Subtypes Exist in Prokaryotic Genomes," PLoS Computational Biology, vol. 1, 2005, pp. 0474-0483.
Haft, D.H., "Hmm Summary Page: TIGR04330", 2012, XP-002757584, http://jcvi.org/cgi-bin/tigrfams/HmmReportPage.cgi?acc=TIGR04330, 1 page.
Hale, et al. "Essential Features and Rational Design of CRISPR RNAs that Function With the Cas RAMP Module Complex to Cleave RNAs", Molecular Cell, vol. 45, 2012, pp. 292-302.
Hale, et al. "RNA-Guided RNA Cleavage by a CRISPR RNA-Cas Protein Complex", Cell, vol. 139, 2009, pp. 945-956.
Hale, et al., "Prokaryotic siliencing (psi) RNAs in *Pyrococcus furiosus*", RNA, vol. 14, 2008, pp. 2572-2579.
Hall, B., et al., "Overview: Generation of Gene Knockout Mice," Current Protocols in Cell Biology, unit 19.12, suppl. 44, Sep. 2009, pp. 1-17.
Handel, E., et al., "Versatile and Efficient Genome Editing in Human Cells by Combining Zinc-Finger Nucleases With Adeno-Associated Viral-Vectors," Human Gene Therapy, vol. 23, 2012, pp. 321-329.
Harrison, et al., "A CRISPR view of development", Genes & Development, vol. 28, 2014, pp. 1859-1872.
Hatoum-Aslan, A., et al., "Mature clustered, regularly interspaced, short palindromic repeats RNA (crRNA) length is measured by a ruler mechanism anchored at the precursor processing site," Proc. Natl. Acad. Sci., vol. 108, Dec. 27, 2011, pp. 21218-21222.
Haurwitz, R.E., et al., "Sequence- and structure-specific RNA processing by a CRISPR endonuclease," Science, vol. 329, 2010, pp. 1355-1358.
Havarstein, L.S., et al., "An unmodified heptadecapeptide pheromone induces competence for genetic transformation in *Streptococcus pneumoniae*," Proc. Natl. Acad. Sci., vol. 92, Nov. 1995, pp. 11140-11144.
Heintze, et al. "A CRISPR CASe for high-throughput silencing", Frontiers in Genetics, vol. 4, 2013, pp. 1-6 DOI:10.3389/gfene.2013.00193.
Hemann et al., "An epi-allelic series of p53 hypomorphs created by stable RNAi produces distinct tumor phenotypes in vivo," Nat Genetics, vol. 33, Mar. 2003, pp. 396-400.
Hibbitt, O., et al., "RNAi-mediated knockdown of HMG CoA reductase enhances gene expression from physiologically regulated low-density lipoprotein receptor therapeutic vectors in vivo," Gene Therapy, vol. 19, 2012, pp. 463-467.
Hicks, et al. "Protein Import Into the Nucleus: An Integrated View", Annu. Rev. Cell Dev. Biology, vol. 11, 1995, pp. 155-188.
Ho, et al., "Targeting non-coding RNAs with the CRISPR/Cas9 system in human cell lines," Nucleic Acids Research, vol. 43, 2015, pp. 1-11.
Hockemeyer, et al., "Highly efficient gene targeting of expressed and silent genes in human ESCs and iPSCs using zinc finger nucleases", Nat Biotechnology, vol. 27, 2009, pp. 851-857, doi:10.1038/nbt.1562.
Holkers, M., et al., "Adenoviral vector DNA for accurate genome editing with engineered nucleases," Nature Methods, vol. 11, 2014, pp. 1051-1057, (Only Abstract Available).
Holmes, "CRISPR Genome Engineering Resources" XP055167586, Oct. 2, 2013, https://groups.google/forum/#!top1c/crispr/5BpJj_Y3yIG [retrieved on Feb. 5, 2015].
Holmes, "Understanding Scores" XP055167918, Oct. 23, 2013, https://groups.google.com/forum/#!profo_nt50txrP9Yb6e_LXccolb9hNf7gKeMLt6rgaVQ4fOsQ/crispr/fkhX7Fu3r-I/rziHxKT76pYJ [retrieved on Feb. 6, 2015].
Horinouchi, S. and Weisblum, B., "Nucleotide sequence and functional map of pC194, a plasmid that specifies inducible chloramphenicol resistance," J. Bacteriology, vol. 150, May 1982, pp. 815-825.
Horton, R.M., "In Vitro recombination and Mutagenesis of DNA: SOEing Together Tailor-Made Genes," Methods Mol. Biology, vol. 15, 1993, pp. 251-261.
Horvath, P. and Barrangou, R. "CRISPR/Cas, the immune system of bacteria and archaea," Science, vol. 327, Jan. 8, 2010, pp. 167-170.
Horvath, P., and Barrangou, R., "RNA-guided genome editing a la carte," Cell Research, vol. 23, 2013, pp. 733-734.
Hosaka, T. et al., "The novel mutation K87E in ribosomal protein S12 enhances protein synthesis activity during the late growth phase in *Escherichia coli*." Mol. Gen. Genomics, vol. 271, 2004, pp. 317-324.
Hoskins, J. et al., "Genome of the bacterium *Streptococcus pneumoniae* strain R6," Journal of Bacteriology, vol. 183, Oct. 2001, pp. 5709-5717.
Hou, Z., et al., "Efficient genome engineering in human pluripotent stem cells using Cas9 from Neisseria meningitides," Proceedings of the National Academy of Sciences, vol. 110, 2013, pp. 15644-15649.
Houdebine, L., "The methods to generate transgenic animals and to control transgene expression," Journal of Biotechnology, vol. 98, 2002, pp. 145-160.
Hsu et al., "Supplementary Information-DNA targeting specificity of RNA-guided Cas9 nucleases," Nature Biotechnology, 2013, doi:10.1038/nbt.2647.

(56) References Cited

OTHER PUBLICATIONS

Hsu, et al., "DNA targeting specificity of RNA-guided Cas9 nucleases," Nature Biotechnology, vol. 31, 2013, pp. 827-834.

Hsu, P., et al., "Development and Applications of CRISPR-Cas9 for Genome Engineering," Cell, vol. 157, 2014, pp. 1262-1278.

*Huang v. California Institute of Technology*, 2004 WL 2296330 (C.D. Cal. Feb. 18, 2004), 20 pages.

Hung, S., et al., "AAV-Mediated CRISPR/Cas Gene Editing of Retinal Cells in Vivo," Investigative Ophthalmology & Visual Science, vol. 57, 2016, pp. 3470-3476.

Husmann, L.K., et al., "Expression of the Arp protein, a member of the M protein family, is not sufficient to inhibit phagocytosis of *Streptococcus pyogenes*," Infection and immunity, vol. 63, Jan. 1995, pp. 345-348.

Hwang W., et al., "Efficient In Vivo Genome Editing Using RNA-Guided Nucleases," Nature Biotechnology, vol. 31, No. 3, Mar. 2013, pp. 227-229 (12 pages).

Hwang, W.Y., et al., "Efficient Genome Editing in Zebrafish Using a CRISPR-Cas System", Nature Biotechnology, vol. 31, No. 3, Jan. 29, 2013, pp. 227-229.

Imagawa, et al., "Two nuclear localization signals are required for nuclear translocation of nuclear factor 1-A", FEBS Letters, vol. 484, 2000, pp. 118-124.

Incontro, S., et al., "Efficient, Complete Deletion of Synaptic Proteins using CRISPR," Neuron, vol. 83, 2014, pp. 1051-1057, 13 pages.

Ishino Y. et al., "Nucleotide sequence of the iap gene, responsible for alkaline phosphatase isozyme conversion in *Escherichia coli*, and identification of the gene product," J. Bacteriology, vol. 169, Dec. 1987, pp. 5429-5433, 5 pages.

Iwamoto et al., "A General Chemical Method to Regulate Protein Stability in the Mammalian Central Nervous System", Chemistry and Biology, Current Biology, vol. 17, Sep. 24, 2010, pp. 981-988, 8 pages.

J. Merkin et al., "Evolutionary dynamics of gene and isoform regulation in Mammalian tissues," Science, vol. 338, Dec. 21, 2012, p. 1593-1599, 7 pages. Includes Supplementary Information, 34 pages.

J.E. Carette et al., "Haploid genetic screens in human cells identify host factors used by pathogens," Science, vol. 326, Nov. 27, 2009, p. 1231-1235, 5 pages.

J.F. Rual et al., "Toward Improving Caenorhabditis elegans Phenome Mapping with an ORFeome-Based RNAi Library," Genome Research, vol. 14, 2004, pp. 2162-2168, 7 pages.

J.M. Engreitz et al., "The Xist lncRNA exploits three-dimensional genome architecture to spread across the X chromosome," Science, vol. 341, Aug. 16, 2013, pp. 1-8, 8 pages.

Jackson, A., et al., "Widespread siRNA "off-target" transcript silencing mediated by seed region sequence complementarity," RNA vol. 12, 2006, pp. 1179-1187, 10 pages.

Jansen R. et al., "Identification of genes that are associated with DNA repeats in prokaryotes," Molecular Microbiology, vol. 43, 2002, pp. 1565-1575, 11 pages.

Janssen, et al., "Mouse Models of K-ras-Initiated Carcinogenesis", Biochimica et Biophysica Acta, vol. 1756 2005, pp. 145-154, 10 pages.

Jao, et al., "Efficient multiplex biallelic zebrafish genome editing using a CRISPR nuclease system", Proceeding of the National Academy of Sciences, PNAS 2013, pp. 1-6, includes supplementary information, pp. 1-10. www.pnas.org/cgi/doi/10.1073/pnas.1308335110.

Jiang, W., et al., "RNA-guided editing of bacterial genomes using CRISPR-Cas systems," Nature Biotechnology, vol. 31, Mar. 2013, pp. 233-239, 30 pages, including supplementary information.

Jinek, M., et al., "A Programmable Dual-RNA-Guided DNA Endonuclease in Adaptive Bacterial Immunity," Science, vol. 337, Aug. 17, 2012 pp. 816-821, including supplementary information, 45 pages.

Jinek, M., et al., "RNA-programmed genome editing in human cells", eLIFE, vol. 2, No. e00471, 2013, 9 pages.

Jinek, M., et al., Figures and figure supplements for: "RNA-programmed genome editing in human cells," eLIFE, vol. 2, 2013, 5 pages.

JL. Mummery-Widmer et al., "Genome-wide analysis of Notch signalling in *Drosophila* by transgenic RNAi," Nature, vol. 458, Apr. 23, 2009, pp. 987-992, 6 pages. Includes Supplementary information, 2 pages.

Joseph, T., and Osman, R., "Thermodynamic basis of selectivity in guide-target-mismatched RNA interference," Proteins, vol. 80, 2012, pp. 1283-1298, 26 pages.

Joshi, et al., "Evolution of I-SceI homing endonucleases with increased DNA recognition site specificity", Journal of Molecular Biology, 2011, vol. 405, pp. 185-200, 16 pages. Includes supplementary information, 14 pages.

Joung, et al., "TALENS: a widely applicable technology for targeted genome editing", Nat Ref. Mol. Cell Biology, vol. 14, 2013, pp. 49-55, 7 pages. doi:10.1038/nrm3586.

K. Yoshimoto et al., "Complex DNA repair pathways as possible therapeutic targets to overcome temozolomide resistance in glioblastoma," Front Oncology, vol. 2, Dec. 2012, pp. 1-8, 8 pages.

K.T. Flaherty et al., "Inhibition of mutated, activated BRAF in metastatic melanoma," The New England Journal of Medicine, vol. 363, Aug. 26, 2010, pp. 1-22, 22 pages.

Kalderon, et al., "A Short Amino Acid Sequence Able to Specify Nuclear Location", Cell, vol. 39, 1984, pp. 499-509, 11 pages.

Kanasty, R., et al., "Delivery materials for siRNA therapeutics," Nature Materials, vol. 12, 2013, pp. 967-977, 11 pages.

Karvelis, et al., "crRNA and tracrRNA guide Cas9-mediated DNA interference in *Streptococcus thermophiles*" RNA Biology, vol. 10, 2013, pp. 841-851, 11 pages.

Karvelis, et al., "Supplemental Material to: crRNA and tracrRNA guide Cas9-mediated DNA interference in *Streptococcus thermophiles*", Landes Bioscience, vol. 10, 2013, pp. 1-8, 9 pages. http://dx.doi.org/10.4161/rna.24203.

Kiani, et al., "CAS9 gRNA engineering for genome editing, activation and repression", Nature Methods, Advanced Online Publication, 2015, pp. 1-6. DOI:10.1038/NMETH.3580.

Kim et al., "High Cleavage Efficiency of a 2A Peptide Derived from Porcine Teschovirus-1 in Human Cell Lines, Zebrafish and Mice," PLoS One, vol. 6, Apr. 2011, pp. 1-8, 8 pages.

Kim, E., et al., "Precision genome engineering with programmable DNA-nicking enzymes," Genome Research, vol. 22, 2012, pp. 1327-1333, 8 pages.

Kim, et al., "Crystal structure of Cas1 from Archaeoglobus fulgidus and characterization of its nucleolytic activity", Biochemical and Biophysical Research Communications, 2013, vol. 441, 2013, pp. 720-725, 6 pages.

Kim, S., et al., "CRISPER RNAs trigger innate immune responses in human cells," Genome Research, 2018, pp. 1-7, 8 pages.

Kinnevey, P., et al., "Emergence of Sequence Type 779 Methicillin-Resistant *Staphylococcus aureus* Harboring a Novel Pseudo Staphylococcal Cassette Chromosome mec (SCCmec)-SCC-SCC CRISPR Composite Element in Irish Hospitals," Antimicrobial Agents and Chemotherapy, vol. 57, 2013, pp. 524-531, 8 pages. Includes Supplementary information, 9 pages.

Kleinstiver et al., "High-fidelity CRISP-Cas9 nucleases with No. detectable genome-wide off-target effects", Nature, vol. 529, Jan. 28, 2016, pp. 490-495, 6 pages. Includes Supplementary information, 12 pages.

Kleinstiver, et al. "Engineered CRISPR-Cas9 nucleases with altered PAM specificities," Nature, vol. 523, vol. 523, 2015, pp. 1-27, 27 pages.

Koike-Yusa, H., et al., "Genome-wide recessive genetic screening in mammalian cells with a lentiviral CRISPR-guide RNA library," Nat Biotechnology, vol. 32, Mar. 2014, pp. 267-273, 7 pages. Including Supplemental information, 3 pages. doi:10.1038/nbt.2800.

Kondo, et al., "Highly Improved Gene Targeting by Germline-Specific Cas9 Expression in *Drosphila*", Genetics, vol. 195, 2013, pp. 715-721, 7 pages. Including Supplemental information 14 pages.

(56) References Cited

OTHER PUBLICATIONS

Konermann, et al., "Genome-scale transcriptional activation by an engineered CRISPR-Cas9 complex", Nature, vol. 517, 2015, pp. 583-588, 6 pages. Including Supplemental information, 12 pages.

Koo et al., "Measuring and Reducing Off-Target Activities of Programmable Nucleases Including CRISPR-Cas9", Molecules and Cells, vol. 38, 2015, pp. 475-481, 7 pages.

Koornneef, A., et al., "Apoliprotein B Knockdown By AAV-Delivered shRNA Lowers Plasma Cholesterol in Mice," Molecular Therapy, vol. 19, 2011, pp. 731-740, 10 pages.

Kosugi, et al. "Six Classes of Nuclear Localization Signals Specific to Different Binding Grooves of Importin a . . . " The Journal of Biological Chemistry, 2009, vol. 284 pp. 478-485, 8 pages. Including Supplemental information, 21 pages.

Kowalski, Thomas J., PowerPoint Presentation, Presented and Discussed during Sep. 9, 2015 Interview (Exhibit B), 51 pages.

Krauer, et al. "Identification of the nuclear localization signals within the Epstein-Barr virus EBNA-6 protein", Journal of General Virology, vol. 85, 2005, pp. 165-172, 8 pages.

Kuhlman, et al. "A place for everything—Chromosomal intergration of large constructs", Bioengineered Bugs, vol. 1, 2010, pp. 296-299, 4 pages.

Kuhlman, et al., "Site-specific chromosomal integration of large synthetic constructs", Nucleic Acids Research, 2010, vol. 38, pp. 1-10, 10 pages. doi:10.1093/nar/gkp1193.

Kumar, M., et al., "Systematic Determination of the Packaging Limit of Lentiviral Vectors," Human Gene Therapy, vol. 12, Oct. 10, 2001, pp. 1893-1905, 21 pages.

Kuwayama, H., "Enhancement of Homologous Recombination Efficiency by Homologous Oligonucleotides," Cell 2012, pp. 233-244, 12 pages. IntechOpen, DOI: 10.5772/47779.

Laganiere et al., "An Engineered Zinc Finger Protein Activator of the Endogenous Glial Cell Line-Derived Neurotrophic Factor Gene Provides Functional Neuroprotection in a Rat Model of Parkinson's Disease", The Journal of Neuroscience, vol. 30, Dec. 8, 2010, pp. 16469-16474, 6 pages.

Lambowitz, et al., "Group II Introns: Mobile Ribozymes that Invade DNA", Cold Spring Harb Perspect Biology, 2011, pp. 1-20, 20 pp. 3:a003616.

Lanford, et al., "Induction of Nuclear Transport with a Synthetic Peptide Homologous to the SV40 T Antigen Transport Signal", Cell, vol. 46, Aug. 15, 1986, pp. 575-582, 8 pages.

Lange, et al. "Classical Nuclear Localization Signals: Definition, Function, and Interaction with Importin$2026" J. Biology, vol. 282, 2007, pp. 5101-5105, 5 pages. including Supplemental information, 5 pages.

Larson, et al., "CRISPR interference (CRISPRi) for sequence-specific control of gene expression", Nature Protocols, vol. 8, 2013, pp. 2180-2196, 17 pages.

Lebherz, C., et al., "Gene therapy with novel adeno-associated virus vectors substantially diminished atherosclerosis in a murine model of familial hypercholesterolemia," The Journal of Gene Medicine, vol. 6, 2004, pp. 663-672, 10 pages.

Lee, C., et al., "Correction of the F508 Mutation in the Cystic Fibrosis Transmembrane Conductance Regulator Gene by Zinc-Finger Nuclease Homology-Directed Repair," Bioresearch Open Access, vol. 1, No. 3, pp. 99-108, dated 2012, 12 pages.

Leenay, et al., "Identifying and Visualizing Functional PAM Diversity across CRISPR-Cas Systems", Molecular Cell, vol. 62, 2016, pp. 137-147, 11 pages.

Lemay, et al., "Folding of the Adenine Riboswitch", Chemistry & Biology, vol. 13, 2006, pp. 857-868, 12 pages.

Levitt, J., et al., "Intrinsic fluorescence and redox changes associated with apoptosis of primary human epithelial cells," Journal of Biomedical Optics, vol. 11, No. 6, pp. 064012-1 to 064012-10, dated Nov./Dec. 2006, 10 pages.

Lewin, et al., "Nuclear localization sequences target proteins to the nucleus" Cells, vol. 5, 2006, 224.

Lewis, et al., "The c-myc and PyMT oncogenes induce different tumor types in a somatic mouse model for pancreatic cancer" Genes & Development, 2003, vol. 17 pp. 3127-3138, 14 pages.

Li et al., "Coevolution of CRISPR-Cas system with bacteria and phages", Hereditas, vol. 33, 2011, pp. 213-218, 6 pages.

Li, et al., "In vivo genome editing restores hemostasis in a mouse model of hemophilia" Nature, 2011, vol. 475, pp. 217-221, 5 pages. doi: 10.1038/nature10177.

Li, et al., "Multiplex and homologous recombination-mediated genome editing in *Arabidopsis* and *Nicotaina benthamiana* using guide RNA and Cas9" Nature Biotechnology, 2013, vol. 31 pp. 688-691, 4 pages.

Li, P., et al., "Biallelic knockout of alpha-1,3 galactosyltransferase gene in porcine liver-derived cells using zing finger nucleases," Journal of Surgical Research, vol. 181, 2013, pp. E39-E45, 7 pages.

Li, Ting, et al. "Modularly assembled designer TAL effector nucleases for targeted gene knockout and gene replacement in eukaryotes" Nucleic Acids Research, vol. 39, 2011, pp. 6315-6325, 11 pages.

Liu, et al. "Epstein-Barr Virus DNase Contains Two Nuclear Localization Signals Which Are Different in Sensitivity to the Hydrophobic Regions" Virology, vol. 247, pp. 62-73, 10 pages, 1998.

Lombardo, A., et al., "Gene editing in human stem cells using zinc finger nucleases and integrase-defective lentiviral vector delivery," Nature Biotechnology, vol. 25, 2007, pp. 1298-1306, 9 pages.

Los, et al., "Halotag Technology: Cell Imaging and Protein Analysis" Cell Notes, vol. 14, 2006, pp. 10-14, 5 pages.

Luo, B., et al., "Highly parallel identification of essential genes in cancer cells," Proceeding of the National Academy of Sciences, vol. 105, 2006, pp. 20380-20385, 6 pages.

Luo, Ming, et al., "Multiple Nuclear Localization Sequences Allow Modulation of 5-Lipoxygenase Nuclear Import" Traffic, 2004, vol. 5, pp. 847-854, 8 pages.

Lyssenko, et al., "Cognate putative nuclear localization signal effects strong nuclear localization of a GFP reporter and facilitates gene expression studies in Caenorhabditis elegans" BioTechniques, 2007, vol. 43 pp. 596-600, 5 pages.

M. Booker et al., "False negative rates in *Drosophila* cell-based RNAi screens: a case study," BMC Genomics, vol. 12, 2011, pp. 1-11, 11 pages.

M. Costanzo et al., "The genetic landscape of a cell," Science, vol. 327, Jan. 22, 2010, pp. 425-431, 8 pages.

Ma, M., et al., "A Guide RNA Sequence Design Platform for the CRISPR/Cas9 System for Model Organism Genomes," Hindawi, vol. 2013, 2013, art. 270805, pp. 1-5, 5 pages.

Maczuga, P., et al., "Embedding siRNA sequences targeting Apolipoprotein B100 in shRNA and miRNA scaffolds results in differential processing and in vivo efficacy," Molecular Therapy, vol. 21, 2013, pp. 217-227, 11 pages.

Madisen et al., "A robust and high-throughput Cre reporting and characterization system for the whole mouse brain," Nat. Neuroscience, vol. 13, Jan. 2010, pp. 133-140, 8 pages.

Maeder, et al., "CRISPR RNA-guided activation of endogenous human genes" Nature Methods, vol. 10, 2013, pp. 977-979, 3 pages. doi.10.1038/nmeth.2556.

Maeder, M., and Gersbach, C., "Genome—editing Technologies for Gene and Cell Therapy," Molecular Therapy, vol. 24, 2016, pp. 430-446, 17 pages.

Maeder, M., et al., "Robust, synergistic regulation of human gene expression using TALE activators," Nature Methods, vol. 10, 2013, pp. 243-245, 3 pages. Including Supplemental information, 6 pages.

Mahfouz, et al., "Targeted transcriptional repression using a chimeric TALE-SRDX repressor protein" Plant Mol Biology, vol. 78, 2012, pp. 311-321, 11 pages.

Mahfouz, M., et al., "De novo-engineered transcription activator-like effector (TALE) hybrid nuclease with novel DNA binding specificity creates double-strand breaks," Proceedings of the National Academy of Science, vol. 108, 2011, pp. 2623-2628, 6 pages.

Makarova, et al., "An updated evolutionary classification of CRISPR-Cas systems" Nature Reviews-Microbiology, vol. 13 2015, pp. 722-736, 15 pages.

(56) References Cited

OTHER PUBLICATIONS

Makarova, K., et al., "Evolution and classification of the CRISPR-CAS Systems," Nature Reviews Microbiology, vol. 9, 2011, pp. 467-477, 11 pages. Including Supplemental information, 23 pages.
Makarova, K., et al., "Unification of Cas protein families and a simple scenario for the origin and evolution of CRISPR-Cas systems," Biology Direct, vol. 6, No. 38, 2011, pp. 1-27, 27 pages.
Mali, et al. "RNA-Guided Human Genome Engineering Via Cas9" Science, vol. 339, pp. 823-826, dated Feb. 15, 2013, 41 pages (Includes Supplemental Information).
Mali, et al., Supplementary Information for "Use of adjacent sgRNA: Cas9 complexes for transcriptional activation and genome engineering," Nature Biotechnology, pp. 1-36, 36 pages. doi:10.1037/nbt.2675, 2013.
Mali, P., et al., "CAS9 transcriptional activators for target specificity screening and paired nickases for cooperative genome engineering," Nature Biotechnology, vol. 31, No. 9, pp. 833-838, dated Aug. 1, 2013, 44 pages (Includes Supplemental Information).
Malina, A., et al., "Repurposing CRISPR/Cas9 for in situ functional assays," Genes & Development, vol. 27, 2013, pp. 2602-2614, 13 pages.
Manjunath, N., et al., "Newer Gene Editing Technologies toward HIV Gene Therapy," Viruses, vol. 5, pp. 2748-2766, 2013, 19 pages.
*Manning v. Paradis*, 296 F.3d 1098 (Fed. Cir. 2012), 9 pages.
Marraffini, L., "CRISPR-Cas Immunity against Phages: Its Effects on the Evolution and Survival of Bacterial Pathogens," PLOS, Dec. 12, 2013, pp. 1-6, 6 pages.
Marraffini, L., Assignment to Rockefeller University, dated Dec. 12, 2013, 3 pages.
Marraffini, L., et al., "Self vs. non-self discrimination during CRISPR RNA-directed immunity," Nature, vol. 463, 2010, pp. 568-571, 13 pages.
Marraffini, L.A., et al., "Sortases and the art of anchoring proteins to the envelopes of gram-positive bacteria," Microbiol. Mol. Biology Review vol. 70, Mar. 2006, pp. 192-221, 3 pages.
Martin, M., "Cutadapt removes adapter sequences from high-throughput sequencing reads," EMBnet.journal, vol. 17, 2011, pp. 10-12, 3 pages.
Mastroianni, et al., "Group II Intron-Based Gene Targeting Reactions in Eukaryotes" Plos One, vol. 3, 2008, pp. 1-15, 15 pages. Doi:10.1371/journal.pone.0003121.
*Maxwell v. The Stanley Works*, 2006 WL 1967012, *5 (M.D. Tenn. Jul. 11, 2006), 7 pages.
Meshorer, et al., "Chromatin in pluripotent embryonic stem cells and differentiation" Nature Reviews Molecular Cell Biology, vol. 7, 2006, pp. 540-546, 7 pages.
Miller, et al., "A Tale nuclease architecture for efficient genome editing" Nature Biotechnology, vol. 29, 2011, pp. 143-150, 8 pages.
Mincer, J., and Simon, S., "Simulations of nuclear pore transport yield mechanistic insights and quantitative predictions," Proceedings of the National Academy of Science, vol. 108, pp. E351-E358, 8 pages, 2011.
Minton, "How can biochemical reactions within cells differ from those in test tubes?" Journal of Cell Science, 2006, vol. 119, pp. 2863-2869, 7 pages.
Moffat J. et al., "A lentiviral RNAi library for human and mouse genes applied to an arrayed viral high-content screen," Cell, vol. 124, Mar. 24, 2006, pp. 1283-1298, 16 pages.
Mojica F. J. M. et al., "Biological significance of a family of regularly spaced repeats in the genomes of Archaea, Bacteria and mitochondria," Molecular Microbiology, vol. 36, 2000, pp. 244-246, 3 pages.
Mojica, F. J., et al., "Short motif sequences determine the targets of the prokaryotic CRISPR defence system, " Microbiology, vol. 155, 2009, pp. 733-740, 8 pages.
Mojica, F. J., et al., Supplementary Material for: "Short motif sequences determine the targets of the prokaryotic CRISPR defence system," Microbiology, vol. 155, 2009, 37 pages.
Morbitzer, et al., "Assembly of custom TALE-type DNA binding domains by modular cloning," Nucleic Acids Research, vol. 39, pp. 5790-5799, 10 pages, 2011.
Morbitzer, et al., "Regulation of selected genome loci using de novo-engineered transcription activator-like effector (TALE)-type transcription factors" PNAS, vol. 108, 2010, pp. 21617-21622, 6 pages.
Morgan, et al., "Inducible Expression and Cytogenetic Effects of the EcoRI Restriction Endonuclease in Chinese Hamster Ovary Cells" Molecular and Cellular Biology, vol. 8, 1988, pp. 4204-4211, 8 pages.
Morin, et al., "Nuclear Localization of the Adenovirus DNA-Binding Protein: Requirement for Two Signals and Complementation during Viral Infection" Molecular and Cellular Biology, vol. 9, 1989, pp. 4372-4380, 9 pages.
Morris et al., "Distributed automated docking of flexible ligands to proteins: Parallel applications of AutoDock 2.4*", Journal of Computer-Aided Molecular Design, 1996, vol. 10, pp. 293-304.
Moscou, et al., "A Simple Cipher Governs DNA Regognition by TAL Effectors" Science, vol. 326, 2009, p. 1501.
Motamedi, M.R., et al., "Double-strand-break repair recombination in *Escherichia coli*: physical evidence for a DNA replication mechanism in vivo," Genes Dev., vol. 13, 1999, pp. 2889-2903.
Mukhopadyay, R., "On the Same Wavelength," ASBMB Today, http://www.asbmb.org/asbmbtoday/201408/Features/Doudna/, dated Aug. 2014, 6 pages.
Mussolino, et al., "TALE nucleases: tailored genome engineering made easy" Current Opinion in Biotechnology, vol. 23, 2012, pp. 644-650, 7 pages.
Musunuru, "Abstract 18593: Use of a CRISPR/Cas System for Cardiovascular Disease Modeling and Therapeutic Applications", Circulation, vol. 128, 2013, 4 pages (Meeting info: American Heart Association, 2013 Scientific Sessions and Resuscitation Science Symposium, Dallas, TX, US, Nov. 16-20, 2013).
Muther, N., et al., "Viral Hybrid Vectors for Somatic Integration—Are They the Better Solution?" Viruses, vol. 1, 2009, pp. 1295-1324, 30 pages.
Nagarajan, et al., "A Hierarchy of Nuclear Localization Signals Governs the Import of the Regulatory Factor X Complex Subunits and MHC Class II Expression" The Journal of Immunology, vol. 173, 2004, pp. 410-419, 11 pages.
Nakai, et al., "PSORT: a program for detecting sorting signals in proteins and predicting their subcellular localization" Trends in Biochem Sciences, vol. 24, 1999, pp. 34-35, 2 pages.
Nakamura, et al., "Codon usage tabulated from international DNA sequence databases: status for the year 2000" Nucleic Acids Research, vol. 28, 2000, p. 292.
Nishimasu, et al., "Crystal Structure of Cas9 in Complex with Guide RNA and Target DNA", Cell, Feb. 27, 2014, vol. 156, pp. 935-949.
Nishimasu, H., et al., "Crystal Structure of *Staphylococcus aureus* Cas9," Cell, vol. 162, Aug. 27, 2015, pp. 1113-1126, 15 pages.
Noguchi, et al., "PDX-1 Protein Containing Its Own Antennapedia-Like Protein Transduction Domain Can Transduce Pancreatic Duct and Islet Cells" Diabetes, 2003, vol. 52 pp. 1732-1737, 6 pages.
Nomura, S., et al., "Low-density lipoprotein receptor gene therapy using helper-dependent adenovirus produces long-term protection against atherosclerosis in a mouse model of familial hypercholesterolemia," Gene Therapy, vol. 11, 2004, pp. 1540-1548, 10 pages.
Notice of Opposition filed Aug. 11, 2017 by Schlich against EP Patent No. 2840140, 58 pages.
Notice of Opposition filed Aug. 14, 2017 by Grund against EP Patent No. 2840140, 64 pages.
Notice of Opposition filed Aug. 16, 2017 by Mathys & Squire LLP against EP Patent No. 2840140, 36 pages.
Notice of Opposition filed by Aug. 16, 2017 by Vossius against EP Patent No. 2840140, 67 pages.
O'Hare, et al., "Transformation of mouse fibroblasts to methotrexate resistance by a recombinant plasmid expressing a prokaryotic dihydrofolate reductase" Proc. Natl. Acad. Sci., vol. 78 2011, 1527-1531, 5 pages.
Opposition Against Appl. Ser. No. EP13818570.7 submitted by Schlich dated Oct. 26, 2015, 8 pages.

(56) References Cited

OTHER PUBLICATIONS

Opposition Against EP Appl. Ser. No. 2771468-B1 dated Oct. 26, 2015, 40 pages.
Ozawa, K., "Gene therapy using AAV," Virus, vol. 57, pp. 47-55, dated, 2007, 13 pages (with English Abstract; No English Translation).
Paddison et al., "A resource for large-scale RNA-interference-based screens in mammals," Nature, vol. 428, Mar. 25, 2004, pp. 427-431, 5 pages.
Pandika, et al., www.ozy.com/rising-stars-and-provocateurs/jennifer-doudna-crispr-code-killer/4690; Jan. 7, 2014.
Panyam, J., and Labhasetwar, V., "Biodegradable nanoparticles for drug and gene delivery to cells and tissue," Advanced Drug Delivery Reviews, vol. 55, 2003, pp. 329-347, 19 pages.
Park, et al., "Regulation of Ribosomal S6 Kinase 2 by Mammalian Target of Rapamycin", The Journal of Biological Chemistry, vol. 277, 2002, pp. 31423-31429, 7 pages.
Pattanayak, et al., "High-throughput profiling of off-target DNA cleavage reveals RNA-programmed Cas9 nuclease specificity," Nature Biotechnology, vol. 31, 2013, pp. 839-843, 5 pages. Including Supplementary Materials, 2 pages.
Patterson, et al., "Codon optimization of bacterial luciferase (lux) for expression in mammalian cells" J. Ind. Microbio. Biotechnology, vol. 32, 2005, 115-123, 9 pages.
Perez-Pinera, et al., "Advances in Targeted Genome Editiong" Curr Opin Chem Biology, vol. 16, 2012, pp. 268-277, 10 pages. doi:10.1016/j.cbpa.2012.06.007, 17 pages.
Perez-Pinera, et al., "RNA-guided gene activation by CRISPR-Cas9-based transcription factors" Nature Methods, 2013, vol. 10, pp. 1-12.
Phillips, A., "The challenge of gene therapy and DNA delivery," The Journal of Pharmacy and Pharmacology, vol. 53, 2011, pp. 1169-1174, 6 pages.
Planey, et al. "Mechanisms of Signal Transduction: Inhibition of Glucocorticoid-induced Apoptosis in 697 Pre-B Lymphocytes by the Mineralocorticoid Receptor N-terminal Domain", Journal of Biological Chemistry, vol. 277, 2002, pp. 42188-42196, 9 pages.
Platt, R., et al., "CRISPR-Cas9 Knockin Mice for Genome Editing and Cancer Modeling," Cell, vol. 159, 2014, pp. 440-455, 16 pages.
Podbielski, A., et al., "R. Novel series of plasmid vectors for gene inactivation and expression analysis in group A streptococci (GAS)," Gene, vol. 177, 1996, pp. 137-147, 11 pages.
Porteus, et al., "Gene targeting using zinc finger nucleases" Nature Biotechnology, Aug. 2005, vol. 23 pp. 967-973, 7 pages.
Porteus, M., and Baltimore, D., "Chimeric Nucleases Stimulate Gene Targeting in Human Cells," Science, vol. 300, 2003, p. 763, 2 pages.
Posfai, et al., "Markerless gene replacement in Escherichia coli stimulated by a double-strand break in the chromosome" Nucleic Acids Resarch, vol. 27, 1999, pp. 4409-4415, 7 pages.
Pougach, et al., "Transcription, Processing and Function of CRISPR Cassettes in *Escherichia coli*" Mol. Microbiology, vol. 77, 2010, pp. 1367-1379, 14 pages.
Pougach, K.S., et al., "CRISPR Adaptive Immunity Systems of Prokaryotes," Molecular Biology, vol. 46, Apr. 2012, pp. 195-203, 1 page (English Abstract).
Pride, D., et al., "Analysis of Streptococcal CRISPRs from Human Saliva Reveals Substantial Sequence Diversity Within and Between Subjects Over Time," Genome Research, vol. 21, 2011, pp. 126-136, 11 pages.
Primo, et al., "Lentiviral vectors for cutaneous RNA managing" Experimental Dermatology, vol. 21, 2012. 162-170, 9 pages.
Qi, et al., "Repurposing CRISPR as an RNA-Guided Platform for Sequence-Specific Control of Gene Expression" Cell, vol. 152, 2013, pp. 1173-1183, 11 pages.
Qi, J., et al., "microRNAs regulate human embryonic stem cell division," Cell Cycle, vol. 8, 2009, pp. 3729-3741, 13 pages.
R. Rad et al., "PiggyBac transposon mutagenesis: a tool for cancer gene discovery in mice," Science, vol. 330, Nov. 19, 2010, p. 1104-1107, 4 pages.
R.D Kolodner and G.T. Marsischky, "Eukaryotic DNA mismatch repair," Current Opinion in Genetics and Development, vol. 9, 1999, p. 89- 96, 8 pages.
R.Renella et al., "Codanin-1 mutations in congenital dyserthropoietic anemia type 1 affect HP1α localization in erythroblasts," Blood, vol. 117, Jun. 2011, pp. 6928-6938, 11 pages.
Radecke, S., et al., "Zinc-finger Nuclease-induced Gene Repair With Oligodeoxynucleotides: Wanted and Unwanted Target Locus Modifications," Molecular Therapy, vol. 18, Apr. 2010, pp. 743-753, 11 pages.
Radulovich, et al., "Modified gateway system for double shRNA expression and Cre/lox based gene expression" BMC Biotechnology, 2011, vol. 11, pp. 1-9, 10 pages.
Ran et al., "Double Nicking by RNA-guided CRISPR Cas9 for enhanced genome editing specificity", Cell, Sep. 12, 2013, vol. 154, pp. 1380-1389.
Ran, F., et al., "In vivo genome editing using *Staphylococcus aureus* Cas9," Nature, vol. 520, 2015, pp. 186-191,6 pages. Includes Supplemental information, 12 pages.
Ran, F., et al., "Genome engineering using the CRISPR-Cas9 system," Nature Protocols, vol. 8, 2013, pp. 2281-2308, 28 pages.
Rand, et al. "Argonaute2 Cleaves the Anti-Guide Strand of siRNA during RISC Activation" Cell, vol. 123, 2005, pp. 621-629, 9 pages.
Raymond, et al. "High-Efficiency FLP and φC31 Site-Specific Recombination in Mammalian Cells" PLoS ONE, vol. 2, Jan. 2007, pp. 1-4. Doi. 10.1371/journal.pone.0000162.
Rebar, et al., "Induction of angiogenesis in a mouse model using engineered transcription factors" Nature Medicine, vol. 8, 2002, pp. 1427-1432, 6 pages.
Redeclaration—37 C.F.R. 41.203(c); filed Mar. 17, 2016 in Patent Interference No. 106,048 (DK), 14 pages.
Reiss, et al., "RecA protein stimulates homologous recombination in plants" Proc. Natl. Acad. Sci. vol. 93, 1996, pp. 3094-3098, 5 pages.
Response to Third Party Observations in EP No. 13824232.6 filed Oct. 2, 2014, with Redlined and Clean Amended Claims, 14 pages.
Rho, M., et al., "Diverse CRISPRs Evolving in Human Microbiomes," PLOS Genetics, vol. 8, Jun. 2012 e1002441, 12 pages.
Rhun, A., and Charpentier, E., "Small RNAs in streptococci," RNA Biology, vol. 9, 2012, pp. 414-426, 13 pages.
Roberts, et al. "Nuclear location signal-mediated protein transport" Biochimica et Biophysica Act, vol. 1008, 1989, pp. 263-280, 18 pages.
Roberts, et al., "The Effect of Protein Content on Nuclear Location Signal Function" Cell, vol. 50, 1989, pp. 465-475, 11 pages.
Rockefeller University and Broad Institute of MIT and Harvard announce update to CRISPR-Cas9 portfolio filed by Broad, Press Release dated Jan. 15, 2018, retrieved from: https://www.broadinstitute.org/news/rockefeller-university-and-broad-institute-mit-and-harvard-announce-update-crispr-cas9, 3 pages.
Rodrigues, et al., "Red Fluorescent Protein (DsRed) as a Reporter in *Saccharomyces cerevisiae*" Journal of Bacteriology, vol. 183, 2001, pp. 3791-3794, 4 pages.
Rodriguez et al., "AAV-CRISPR: A New Therapeutic Approach To Nucleotide Repeat Diseases", Molecular Therapy, vol. 22, 2014, Supplement 1, Abstract 247, p. S94.
Rolling, "Recombinant AAV—mediated gene transfer to the retina: gene therapy perspectives", Gene Therapy, vol. 11, 2004, pp. S26-S32, 5 pages.
*Rubin v. The General Hospital Corp.*, 2011-1439 (Fed. Cir. Mar. 28, 2013), 8 pages.
S. Huang et al., "MED12 Controls the Response to Multiple Cancer Drugs through Regulation of TGF-β; Receptor Signaling," Cell, vol. 151, 2012, pp. 937-950, 14 pages.
S. Konermann et al., "Optical control of mammalian endogenous transcription and epigenetic states," Nature, vol. 500, Aug. 22, 2013, pp. 472-476, 5 pages. Includes Supplemental Information, 13 pages.
S.H. Chen et al., "A Knockout Mouse Approach Reveals that TCTP Functions as an Essential Factor for Cell Proliferation and Survival in a Tissue- or Cell Type-specific Manner," Molecular Biology of the Cell, vol. 18, Jul. 2007, pp. 2525-2532, 8 pages.

(56) References Cited

OTHER PUBLICATIONS

S.R. Whittaker et al., "A Genome-Scale RNA Interference Screen Implicates NF1 Loss in Resistance to RAF Inhibition," Cancer Discovery, vol. 3, 2013, pp. 350-362, 14 pages.

S.S. Liu et al., "Identification and characterization of a novel gene, c1orf109, encoding a CK2 substrate that is involved in cancer cell proliferation," Journal of Biomedical Science, vol. 19, 2012, 12 pages.

S.Xue and M. Barna, "Specialized ribosomes: a new frontier in gene regulation and organismal biology," Nat Rev Mol Cell Biology, vol. 13, Jun. 2012. pp. 355-369, 15 pages.

Sadowski, M., and Jones, D., "The sequence-structure relationship and protein function prediction," Current Opinion in Structural Biology, vol. 19, 2009, pp. 357-362, 6 pages.

Sambrook, et al., "Molecular Cloning, A Laboratory Manual on the Web", Cold Spring Harbor Laboratory Press, Chapter 16, 2001, downloaded from http://www.molecularcloning.com/members/chapter.jsp?chapter=127 on Feb. 19, 2002, 13 pages.

Sander, et al., "CRISPR-Cas systems for editing, regulating and targeting genomes," Nature Biotechnology, vol. 32, 2014, pp. 347-355, 9 pages.

Sanders, "Cheap and easy technique to snip DNA could revolutionize gene therapy", UC Berkeley Press Release, Jan. 7, 2013, available at http://newscenter.berkeley.edu/2013/01/07/cheap-and-easy-technique-to-snip-dna-could-revolutionize-gene-therapy/.

Sanders, et al., "Use of a macromolecular crowding agent to dissect interactions and define functions in transcriptional activation by a DNA-tracking protein: Bacteriophage T4 gene 45 protein and late transcription" PNAS, vol. 9 2014, pp. 7703-7707, 5 pages.

Sanjana, et al., "Improved vectors and genome-wide libraries for CRISPR screening," HHS Public Access Author Manuscript, vol. 11, 2014, pp. 2145-2148, 4 pages.

Sanjana, N., et al., "A Transcription Activator-Like Effector (TALE) Toolbox for Genome Engineering," Nature Protocols, vol. 7, 2012, pp. 171-192, 39 pages.

Sapranauskas, R., et al., "The *Streptococcus thermophilus* CRISPR-Cas system provides immunity in *Escherichia coli*," Nucleic Acids Research, vol. 3, 2011, pp. 9275-9282, 8 pages.

Sarra, G., et al., "Gene replacement therapy in the retinal degeneration slow (rds) mouse: the effect on retinal degeneration following partial transduction of the retina", Human Molecular Genetics, vol. 10, 2001, pp. 2353-2361, 9 pages.

Sato, et al. "Generation of Adeno-Associated Virus Vector Enabling Functional Expressionof Oxytocin Receptor and Fluorescence Marker Genes Using the Human eIF4G Internal Ribosome Entry Site Elemet" Biosci. Biotechno. Biochem, vol. 73, 2009, pp. 2145-2148, 4 pages.

Sauer, "Functional Expression of the cre-lox Site-Specific Recombination System in the Yeast *Saccharomyces cerevisiae*" Mol. Cell. Biology, vol. 7, 1987, pp. 2087-2096, 10 pages.

Sauer, et al. "Site-specific DNA recombination in mammalian cells by the Cre recombinase of bacteriophage P1" Proc. Natl. Acad. Sci. vol. 85, 1988, pp. 5166-5170, 5 pages.

Schiffer, et al. "Targeted DNA Mutagenesis for the Cure of Chronic Viral Infections" Journal of Virology, vol. 86, No. 17, Jun. 20, 2012, pp. 8920-8936.

Schiffer, et al., "Predictors of Hepatitis B Cure Using Gene Therapy to Deliver DNA Cleavage Enzymes: A Mathematical Modeling Approach" PLOS Computational Biology, vol. 9, 2013, pp. 1-16. www.ploscompbiol.org.

Scholze, et al., "TAL effector-DNA specificity", Virulence, vol. 1, No. 5, Sep. 1, 2010, pp. 428-432, 5 pages DOI:10.4161/viru.1.5.12863.

Schramm et al., "Recruitment of RNA polymerase III to its target promoters" Genes & Development, vol. 16, 2002, 2593-2620, pp. 28 pages.

Schunder et al., "First indication for a functional CRISPR/Cas system in Francisella tularensis", International Journal of Medical Microbiology, vol. 303, 2013, pp. 51-60, 10 pages.

Sebastiani, et al., "BCL11A enhancer haplotypes and fetal hemoglobin in sickle cell anemia," Blood Cells, vol. 54, 2015, pp. 2240230, 7 pages.

Sebo, et al., "A simplified and efficient germline-specific CRISPR/Cas9 system for *Drosophila* genomic engineering" Fly, 2014, vol. 8, pp. 52-57, 8 pages.

Seffernick, J., et al., "Melamine Deaminase and Atrazine Chlorohydrolase: 98 Percent Identical but Functionally Different," Journal of Bacteriology, vol. 183, No. 8, Apr. 2001, pp. 2405-2410, 6 pages.

Semenova, E. et al., "Interference by clustered regularly interspaced short palindromic repeat (CRISPR) RNA is governed by a seed sequence," Proc. Natl. Acad. Sci., vol. 108, Jun. 21, 2011, pp. 10089-10103, 7 pages.

Senis, E., et al., "CRISPR/Cas9-mediated genome engineering: An adeno-associated viral (AAV) vector toolbox," Biotechnology Journal, vol. 9, 2014, pp. 1402-1412, 12 pages.

Senturk et al., "A rapid and tunable method to temporally control cas9 expression enables the identification of essential genes and the interrogation of functional gene interactions in vitro and in vivo," vol. 9, 2015, pp. 1-27, XP002756303, doi:10.1101/023366, Retrieved from the Internet: URL:http://biorxiv.org/content/early/2015/07/28/023366 [retrieved on Apr. 11, 2016).

Shalem, et al., "High-throughput functional genomics using CRISP-Cas9," Nature Reviews Genetics, vol. 16, No. 5, pp. 299-311, May 2015.

Shalem, O., et al., "Genome-Scale CRISPR-Cas9 Knockout Screening in Human Cells," Science, vol. 343, 2014, pp. 84-87, 5 pages.

Sharan, et al., "Recombineering: A Homologous Recombination-Based Method of Genetic Engineering" Nat. Protoc., 2009, vol. 4 pp. 206-223, 18 pages. doi:10.1038/nprot.2008.227.

Shen, B., et al., "Generation of gene-modified mice via Cas9/RNA-mediated gene targeting," Cell Research, vol. 23, 2013, pp. 720-723.

Shen, et al., "Efficient genome modification by CRISPR-Cas9 mickase with minimal off-target effects" 2014, Nature Methods, vol. 11, pp. 399-404, 6 pages.

Shengdar Tsai et al., "Dimeric CRISPR RNS-guided FokI nucleases for highly specific genome editing", Nature Biotechnology, vol. 32, Jun. 2014, pp. 569-576, 18 pages.

Shieh, et al., "Nuclear Targeting of the Maize R. Protein Requires Two Nuclear Localization Sequences" Plant Physiol, 1993, vol. 101 pp. 353-361, 9 pages.

Siegl, et al., "I-SceI endonuclease: a new tool for DNA repair studies and genetic manipulations in streptomycetes" Appl Microbiol Bitotechnol, vol. 87, 2010, pp. 1525-1532, 8 pages.

Sims, D., et al., "High-throughput RNA interference screening using pooled shRNA libraries and next generation sequencing," Genome Biology, vol. 12, 2011, pp. 1-13.

Singer, et al., "Applications of Lentiviral Vectors for shRNA Delivery and Transgenesis" Curr Gene Ther., vol. 8, 2008 pp. 483-488, 6 pages.

Slaymaker et al., "Rationally engineered Cas9 nucleases with improved specificity", Science, American Association for the Advancement of Science, US, vol. 351, Jan. 1, 2016, pp. 84-88.

Sontheimer, "Project 7: Establishing RNA-Directed DNA Targeting in Eukaryotic Cells" Physical Sciences-Onc., Nov. 16, 2011-Dec. 31, 2012, 2 pages. htt://groups.molbiosci.northwestern.edu/sontheimer/Sontheimer_cv.php) Molecular Biosciences, 2 pages.

Spencer, J.M., et al., "Development of a Nuclease Screen to Improve Cas9 Targeting Specificity", Molecular Therapy, May 2015, vol. 23, Suppl. 1, S136(340).

Stewart SA et al., "Lentivirus-delivered stable gene silencing by RNAi in primary cells," RNA, vol. 9, 2003, pp. 493-501, 9 pages.

Stolfi, et al., "Tissue-specific genome editing in Ciona embryos by CRISPR/Cas9," Development, vol. 141, 2014, pp. 4115-4120, 6 pages. doi:10.1242/dev.114488.

Stoller, J. and Aboussouan, L., "Alpha1-antitrypsin deficiency," The Lancet, Seminar, vol. 365, 2005, pp. 2225-2236, 12 pages.

Stratikopoulos, E., et al., "The hormonal action of IGF1 in postnatal mouse growth," Proceedings of the National Academy of Sciences, vol. 105, Dec. 9, 2008, pp. 19378-19383, 6 pages.

(56) References Cited

OTHER PUBLICATIONS

Straub, C., et al., "CRISPR/Cas9-Mediated Gene Knock-Down in Post-Mitotic Neurons," PLOS One, vol. 9, art. E105584, Aug. 20, 2014, pp. 1-5, 6 pages.

Sung, et al., "An rpsL Cassette, Janus, for Gene Replacement through Negative Selectionin *Streptococcus pneumoniae*" Applied and Environmental Microbiology, vol. 67, 2001, pp. 5190-5196, 7 pages.

Sung, M., et al., "The importance of valency in enhancing the import and cell routing potential of protein transduction domain-containing molecules," Biochimica et Biophysica Aeta, vol. 1758, pp. 355-363, dated 2006, 9 pages.

Sung, Young Hoon, et al., "Mouse genetics: Catalogue and scissors" BMB Reports, 2012, vol. 45 pp. 686-692, 7 pages.

Suzuki, K., et al., "In vivo genome editing via CRISPR/Cas9 mediated homology-independent targeted integration," Nature, vol. 540, art. 7631, 2015, pp. 1-44.

Swarthout, J., et al., "Zinc Finger Nucleases: A new era for transgenic animals," Annals of Neurosciences, vol. 18, 2011, pp. 25-28, 4 pages.

Swiech et al., "CRISPR-Mediated Genome Editing in the Mammalian Brain", Molecular Therapy, 747, vol. 22, 2014, p. S289.

Swiech, L., et al., "In vivo interrogation of gene function in the mammalian brain using CRISPR-Cas9," Nature Biotechnology, vol. 33, 2014, pp. 102-106, 5 pages. Including Supplemental information, 4 pages.

Symington et al., "Double-Strand Break End Resection and Repair Pathway Choice", Annual Review of Genetics, vol. 45, 2011, pp. 247-271, 25 pages.

T. Horii et al., "Generation of an ICF Syndrome Model by Efficient Genome Editing of Human Induced Pluripotent Stem Cells Using the CRISPR System," International Journal of Molecular Sciences, vol. 14, 2013, p. 19774- 19781, 9 pages.

T.J. Cradick et al., "CRISPR/Cas9 systems targeting β-globin and CCR5 genes have substantial off-target activity," Nucleic Acids Research, vol. 41, 2013, 9584-9592, 9 pages.

T.Yan et al., "DNA mismatch repair (MMR) mediates 6-thioguanine genotoxicity by introducing single-strand breaks to signal a G2-M arrest in MMR-proficient RKO cells," Clinical Cancer Research, vol. 9, Jun. 2003, p. 2327-2334, 9 pages.

Takara Bio USA, Inc., "Lenti-X™ Tet-On© 3G CRISPR/Cas9 System User Manual", 2016, pp. 1-35.

Tang, T., et al., "A mouse knockout library for secreted and transmembrane proteins," Nature Biotechnology, vol. 28, No. 7, Jul. 2010, pp. 749-755, pp. 7 pages. Including Supplemental information, 2 pages.

Terns, M., and Terns, R., "CRISPR-based adaptive immune systems," Current Opinion in Microbiology, vol. 14, 2011, pp. 321-327, 8 pages.

*The Broad Inst.* v. *The Regents of University of UCA*—Decision on Motions for Patent Interference No. 106,048 filed Feb. 15, 2017, 51 pages.

Third Party Observation for Application No. EP20130824232 dated Sep. 22, 2014, 19 pages.

Third Party Observation in Application No. PCT/US2013/074819 dated Apr. 10, 2015, 10 pages.

Third Party Observation Under Article 115 EPC in Application No. 13818570.7 dated Oct. 1, 2014.

Third Party Observations Concerning App. No. GB1420270.9, dated Jun. 30, 2015, 71 pages.

Third Party Observations Concerning Appl. No. EP2800811, dated Jul. 24, 2015, 108 pages.

Third Party Observations Concerning Appl. No. EP2800811, dated Sep. 4, 2015.

Third Party Observations Concerning Appl. No. GB1420270.9 dated Jun. 30, 2015.

Third Party Observations Concerning Appl. No. GB1420270.9, dated Jul. 13, 2015.

Third Party Observations in Accordance with Article 115 EPC, Appl. No. EP13824232.6, Pub. No. EP2764103A, Mar. 25, 2015.

Third Party Observations submitted by Broad Institute Inc. Concerning Appl. Ser. No. EP13793997.1 dated Jul. 24, 2015, 108 pages.

Third Party Observations submitted by Broad Institute Inc. Concerning Appl. Ser. No. EP13793997.1 dated Sep. 4, 2015, 25 pages.

Third Party Observations submitted by Regents of the University of California et al. Concerning App. No. GB1420270.9 dated Jul. 13, 2015, 18 pages.

Third Party-Observations, Appl. No. 1382432.6, Pub. No. EP2764103, dated Feb. 16, 2015, 12 pages.

Third-Party Observation for Application No. EP20130824232 dated Sep. 8, 2014, 47 pages.

Tinland, et al., "The T-DNA-linked VirD2 protein contains two distinct functional nuclear localization signals" Proc. Natl. Acad. Sci, vol. 89, 1992, pp. 7442-7446, 5 pages.

Tiscornia, et al. "Development of Lentiviral Vectors Expressing siRNA" Gene Transfer-Delivery and Expression of DNA and RNA—A Laboratory Manual, 2007, Chapter 3 pp. 23-34, 12 pages.

Tolia, et al., "Slicer and the Argonautes" Nature Chemical Biology, vol. 3, 2007, pp. 36-43, 8 pages.

Trafton, A., "CRISPR—carrying nanoparticles edit the genome," MIT News, dated Nov. 13, 2017, 3 pages.

Trevino, et al., "Genome Editing Using Cas9 Nickases" Methods in Enxymology, vol. 546 pp. 161-174, 14 pages, 2014.

Tulpan, D., et al., "Free energy estimation of short DNA duplex hybridizations," BMC Bioinformatics, vol. 11, 2012, pp. 105-127, 23 pages.

Type V CRISPR-associated protein Cpfi [*Acidaminococcus* sp. Bv3L6], 2017, NCBI Reference Sequence: WP_02173622.1, Non-redundant Protein Sequence, 2 pages.

*Ultra-Precision Mfg. Ltd.* v. *Ford Motor Co.*, 2004 WL 3507671, *7, *11-12 (E.D. Mich. Mar. 30, 2004).

Urnov, et al., "Highly efficient endogenous human gene correction using designed zinc-finger nucleases" Nature, vol. 435, 2005, pp. 646-651, 6 pages.

Urnov, F., et al., "Genome editing with engineered zinc finger nucleases," Nature Reviews, Genetics, vol. 11, pp. 637-646, dated Sep. 2010, 11 pages.

Urrutia, et al., "KRAB—containing zing finger repressor proteins" Genome Biology, vol. 4, Sep. 23, 2003, pp. 231-231.8, 8 pages.

V.N. Ngo et al., "A loss-of-function RNA interference screen for molecular targets in cancer," Nature, vol. 441, May 4, 2006, pp. 106-110, 5 pages.

Van Den Ackerveken, et al., "Recognition of the Bacterial Avirulence Protein AvrBs3 Occurs inside the Host Plant Cell" Cell, vol. 87, Dec. 27, 1996, pp. 1307-1316, 10 pages.

Van Der Oost, "New tool for genome surgery", Science, vol. 339, Feb. 15, 2013, pp. 768-770, 3 pages.

Van Der Oost, J., et al., "CRISPR-based adaptive and heritable immunity in prokaryotes," Trends. Biochem. Sci., vol. 34, 2009, pp. 401-407, 7 pages.

Van Nierop, G., et al., "Stimulation of homology-directed gene targeting at an endogenous human locus by a nicking endonuclease," Nucleic Acids Research, vol. 37, 2009, pp. 5725-5736, 12 pages.

Venken et al., "P[acman]: A BAC Transgenic Platform for Targeted Insertion of Large DNA Fragments in D. melanogaster", Science, vol. 314, Dec. 15, 2006, pp. 1747-1751, 5 pages.

Vestergaard et al.:., "CRISPR adaptive immune systems of Archaea", RNA Biology, vol. 11,2014, pp. 156-167, 12 pages.

Villion, et al., "The double-edged sword of CRISPR-Cas systems" Cell Research, 2013, vol. 23 pp. 15-17, 3 pages.

W.G. Kaelin., "Use and Abuse of RNAi to Study Mammalian Gene Function," Science, vol. 337, Jul. 27, 2012, p. 421-422, 2 pages.

Wang, et al. "Genetic Screens in Human Cells Using the CRISPR-Cas9 System", Science, 2014, 343:80-84.

Wang, H., et al., "One-Step Generation of Mice Carrying Mutations in Multiple Genes By CRISPR/Cas-Mediated Genome Engineering," Cell, vol. 153, 2013, pp. 910-918, 9 pages.

Wang, H.H et al., "Genome-scale promoter engineering by coselection MAGE," Nat methods, vol. 9, Jun. 2012, pp. 591-593, 3 pages.

Wayengera, M., "Identity of zinc finger nucleases with specificity to herpes simplex virus type II genomic DNA; novel HSV-2 vaccine/

(56) References Cited

OTHER PUBLICATIONS therapy precursors", Theoretical Biology and Medical Modelling, vol. 8, No. 1, Jun. 24, 2011, p. 23.
Wayengera, M., "Zinc finger arrays binding human papillomavirus types 16 and 18 genomic DNA: precursors of gene-therapeutics for in-situ reversal of associated cervical neoplasia", Theoretical Biology and Medical Modeling, vol. 9, No. 1, Jul. 28, 2012, p. 30.
Weber et al., "TALENs Targeting HBV: Designer Endonuclease Therapies for Viral Infections", Molecular Therapy, vol. 21, Oct. 2013, pp. 1819-1821, 3 pages.
Welch, et al., "Designing Genes For Successful Protein Expression" Methods in Enzymology, 2011, vol. 498, pp. 43-66, 24 pages. Doi: 10.1016/B978-0-12-385120-8.00003-6.
Wiedenheft, B. et al., "RNA-guided complex from a bacterial immune system enhances target recognition through seed sequence interactions," Proc. Natl. Acad. Sci., vol. 108, Jun. 21, 2011, 10092-10097, 7 pages.
Wiedenheft, B. et al., "RNA-guided genetic silencing systems in bacteria and archaea", Nature, vol. 482, Feb. 16, 2012, pp. 331-338.
Wienert, B., et al., "In vitro transcribed guide RNAs trigger an innate immune response via the RIG-I pathway," BioRxiv Preprint, 2018, 1-28, 28 pages.
Witkowski, A., et al., "Conversion of a Beta-Ketoacyl Synthase to a Malonyl Decarboxylase by Replacement of the Active-Site Cysteine with Glutamine," Biochemistry, vol. 38, 1999, pp. 11643-11650, 8 pages.
Wittmann et al., "Engineered riboswitches: Expanding researchers' toolbox with synthetic RNA regulators", FEBS Letters, vol. 586, 2012, pp. 2076-2083, 8 pages.
Wolff, et al., "Nuclear security breached" Nature Biotechnology, Dec. 2001, vol. 19, 1118-1120, 3 pages.
Wu, X., et al., "Genome-wide binding of the CRISPR endonuclease Cas9 in mammalian cells," Nature Biotechnology, 2014, 1-7, 7 pages. Including Supplemental information, 2 pages.
Wu, Y., et al., "Correction of a Genetic Disease in Mouse via Use of CRISPR-Cas9," Cell Stem Cell, vol. 13, 2013, pp. 659-662, 4 pages.
Wu, Z., et al., "Effect of Genome Size on AAV Vector Packaging," The American Society of Gene & Cell Therapy, vol. 18, 2010, pp. 80-86, 7 pages.
X.Liu et al., "STAGA recruits Mediator to the MYC oncoprotein to stimulate transcription and cell proliferation," Molecular and cellular biology, vol. 28, Jan. 2008, p. 108-121, 14 pages.
Xiao, et al., "Chromosomal deletions and inversions mediated by TALENs and CRIPPR/Cas in zebrafish" Nucleic Acids Research, vol. 41, 2013, pp. 1-11, Including Supplemental information, 31 pages. doi:10.1093/nar/gkt464.
Xiao, et al., "Production of High-Titer Recombinant Adeno-Associated Virus Vectors in the Absence of Helper Adenovirus" Journal of Virology, Mar. 1998, vol. 72, No. 3, pp. 2224-2232, 9 pages.
Xiao, W., et al., "Gene Therapy Vectors Based on Adeno-Associated Virus Type 1", Journal of Virology, May 1999, vol. 73, No. 5, p. 3994-4003.
Xie, et al. "RNA-Guided Genome Editing in Plants Using a CRISPR-Cas System" Molecular Plant, vol. 6, Nov. 2013, 1975-1983, 9 pages.
Xu, Zhi-Li et al., "Regulated gene expression from adenovirus vectors: a systematic comparison of various inducible systems," Gene, vol. 309, 2003, pp. 145-151, 7 pages.
Yaghmai, et al., "Optimized Regulation of Gene Expression Using Artificial Transcription Factors", Molecular Therapy, Jun. 2002, vol. 5, No. 6, pp. 685-694.
Yamano, et al., "Crystal Structure of Cpf1 in Complex with Guide RNA and Target DNA" Cell, vol. 165, May 5, 2016, pp. 949-962, 14 pages.
Yanfang Fu et al., "Improving CRISPR-Cas nuclease specificity using truncated guide RNAs" (with Supplement Table), Nature Biotechnology, vol. 32, Mar. 2014, pp. 1-18.

Yang et al., "HIV-1 TAT-mediated protein transduction and subcellular localization using novel expression vectors," FEBS Letters, vol. 532, 2012, pp. 36-44, 9 pages.
Yang, H., et al., "One-Step Generation of Mice Carrying Reporter and Conditional Alleles by CRISPR/Cas-Mediated Genome Engineering," Cell, vol. 154, 2013, pp. 1370-1379, 10 pages. Including Supplemental information, 4 pages.
Yi, et al., "Current Advances in Retroviral Gene Therapy" Current Gene Therapy, vol. 11, 2011, pp. 218-228, 11 pages.
Yin, H., et al., "Structure-guided chemical modification of guide RNA enables potent non-viral in vivo genome editing," Nature Biotechnology, vol. 35, Dec. 2017, pp. 1-22.
Yu, et al., "An efficient recombination system for chromosome engineering in *Escherichia coli*" PNAS, 2000, vol. 97, pp. 5978-5983, 6 pages.
Yu, W., et al., "Nrl knockdown by AAV-delivered CRISPR/Cas9 prevents retinal degeneration in mice," Nature Communications, vol. 8, 2017, art. 14716, 15 pages.
Yu, Zhongshen, et al., "Highly Efficient Genome Modifications Mediated by CRISPR/Cas9 in *Drosophila*" Genetics, 2013, vol. 195 pp. 289-291, 3 pages.
Yusuke Miyazaki et al., Destabilizing Domains Derived from the Human Estrogen Receptor:, Journal of the American Chemical Society, vol. 134, Mar. 7, 2012, pp. 3942-3945, 4 pages.
Zahner, D. and Hakenbeck, R. "The *Streptococcus pneumoniae* beta-galactosidase is a surface protein," J. Bacteriology, vol. 182, Oct. 2000, pp. 5919-5921, 3 pages.
Zeng Y et al., "Both natural and designed micro RNAs can inhibit the expression of cognate mRNAs when expressed in human cells," Mol Cell., vol. 9, Jun. 2002, pp. 1327-1333, 7 pages.
Zetsche et al. "A split-Cas9 architecture for inducible genome editing and transcription modulation" Nature biotechnology, 2015, vol. 33, 139-142, 4 pages.
Zetsche et al., "Cpf1 is a single RNA-guided endonuclease of a class 2 CRISPR-Cas system", Cell, vol. 163, Oct. 22, 2015, pp. 759-771, 13 pages.
Zhang, "Processing-Independent CRISPR RNAs Limit Natural Transformation in Neisseria meningitidis", Molecular Cell, vol. 50, May 23, 2013 pp. 488-503.
Zhang, et al. "Optogenetic interrogation of neural circuits: technology for probing mammalian brain structures" Nat Protoc., 2010, 5(3):439-456, doi:10.1038/nprot.2009.226.
Zhang, et al., "Optimized CRISPR Design", MIT, XP055167487, Oct. 23, 2013, URL:http//crispr.mit.edu/about[retrieved on Feb. 5, 2015].
Zhang, et al., "Efficient construction of sequence-specific TAL effectors for modulating mammalian transcription" nature biotechnology, vol. 29, 2011, 149-154, 6 pages.
Zhang, F., PowerPoint Presentation: "Development and Applications of CRISPR-Cas9 for Genome Editing," Broad Institute/MIT, dated Sep. 9, 2015, 50 pages.
Zhang, L., et al., "Efficient Expression of CFTR Function with Adeno-Associated Virus Vectors that Carry Shortened CFTR Genes," Proceedings of the National Academy of Science USA, vol. 95, 1998, pp. 10158-10163, 6 pages.
Zhang, X. D., et al., "cSSMD: assessing collective activity for addressing off-target effects in genome-scale RNA interference screens," Bioinformatics, vol. 27, pp. 2775-2781, 2011, 7 pages.
Zhou, et al., "High-throughput screening of a CRISPR/Cas9 library for functional genomics in human cells," Nature, vol. 509, pp. 487-491, 5 pages, 2014.
Zhu, et al. "Crystal structure of Cmr2 suggests a nucleotide cyclase-related enzyme in type III CRISPR-Cas sytems" FEBS Letters, 2012, 939-945, 6 pages. Doi:10.1016/j.febslet2012.02.036.
Zolkiewska, et al., "ADAM Proteases:Ligand Processing and Modulation of the Notch Pathway" Cell Mol Life Sci, 2008, vol. 65 pp. 2056-2068, 13 pages.
Zuris, et al., "Cationic lipid-mediated delivery proteins enables efficient protein-based genome editing in vitro and in vivo", Nature Biotechnology, vol. 33, No. 1, Jan. 2015, pp. 73-80.
Zuris, et al., "Efficient Delivery of Genome-Editing Proteins In Vitro and In Vivo" Nature Biotechnology, vol. 33, No. 1, Jan. 2015, pp. 1-26.

(56) References Cited

OTHER PUBLICATIONS

Zuris, et al., Supplementary Information—"Cationic lipid-mediated delivery proteins enables efficient protein-based genome editing in vitro and in vivo" Nature Biotechnology, vol. 33, No. 1, Jan. 2015, pp. 1-49. doi:10.1038/nbt.3081.

Adhin et al., "Complete nucleotide sequence of the group I RNA bacteriophage fr," Biochimica et Biophysica Acta, Elsevier, vol. 1050, 1990 pp. 104-109.

Anders et al., "Structural basis of PAM-dependent target DNA recognition by the Cas9 endonuclease," Nature, vol. 513, Sep. 25, 2014 pp. 569-573.

Anguela et al., "Robust ZFN-mediated geno1ne editing in adult hemophilic mice", Blood, vol. 122, No. 19, Nov. 7, 2013, (pp. 3283-3287).

Bikard et al., "Exploiting CRISPR-Cas nucleases to produce sequence-specific antimicrobials", Nature Biotechnology, vol. 32, No. 11, Nov. 2014 (pp. 1146-1151).

Chapdelaine et al., "Meganucleases can restore the reading frame of a mutated dystrophin", Gene Therapy, vol. 17, 2010 (pp. 846-858).

Database UniPro Accession No. J7RUA5, 2012, [online] downloaded from https://www.uniprot.org/uniprol/J7RUA5 on Mar. 23, 2021 (10 pages).

Decision on Motions—PTAB, *The Regents of the University of California v. The Broad Institute, Inc.*, filed Sep. 10, 2020, in Patent Interference No. 106,115 (DK), 113 pages.

Declaration of Interference—PTAB, *The Broad Institute, Inc., Massachusetts Institute of Technology*, and *President and Fellows of Harvard College v. Toolgen, Inc.*, filed Dec. 14, 2020, in Patent Interference No. 106,126 (DK), 19 pages.

Guilinger et al., "Fusion of catalytically inactive Cas9 to FokI nuclease improves the specificity of genome modification," Nature Biotechnology, vol. 32, No. 6, Jun. 2014 (pp. 577-582).

He et al., "Pollen fertility restoration by nuclear gene Fr in CMS common bean: an Fr linkage map and the mode of Fr action," Theor. Appl. Genet. vol. 90, 1995, pp. 1056-1062.

Hemphill et al., "Optical Control of CRISPR/Cas9 Gene Editing," Journal of the American Chemical Society, vol. 137, May 6, 2015 (9 pages).

Hirano et al., "Structure and Engineering of Francisella novicida Cas9," Cell, vol. 164, Feb. 25, 2016, pp. 950-961.

Huang and Honkanen, "Molecular Cloning, Expression, and Characterization of a Novel Human Serine/Threonine Protein Phosphatase, PP7, That is Homologous to '*Drosophila*' Retinal Degeneration C Gene Product (rdgC)*," The Journal of Biological Chemistry, vol. 273, No. 3, Iss. 16, 1998, pp. 1462-1468.

Jinek et al., "RNA-programmed genome editing in human cells", eLife, vol. 2, 2013, DOI: 10.7554/eLife.00471 (9 pages).

Koonin et al., "Diversity, classification and evolution of CRISPR-Cas systems", Current Opinion in Microbiology vol. 37, 2017 (pp. 67-78).

Ran, F.A., "CRISPR-Cas: Development and Applications for Mammalian Genome Editing", Ph.D. Dissertation, Harvard University, Apr. 2014 (190 pages).

Redeclaration—PTAB, *The Regents of the University of California v. The Broad Institute, Inc.*, filed Aug. 26, 2019, in Patent Interference No. 106,115 (DK), 20 pages.

Redeclaration—PTAB, *The Regents of the University of California v. The Broad Institute, Inc.*, filed Sep. 10, 2020, in Patent Interference No. 106,115 (DK), 3 pages.

Slaymaker et al., "Rationally engineered Cas9 nucleases with improved specificity", Science, vol. 351, No. 6268, Jan. 1, 2016, pp. 84-88.

Sorek et al., "CRISPR—Mediated Adaptive Immune Systems in Bacteria and Archea", Annual Review of Biochemistry, vol. 82, 2013, (pp. 237-266).

Stoddard, "Homing endonuclease structure and function," Quarterly Reviews of Biophysics, Cambridge University Press, 2005 (pp. 1-47).

Taylor, G., "Introduction to phasing," Acta Crystallographica Section D Biological Crystallography, 2010, D66 (pp. 325-338).

Voytas, Daniel F., "Plant genome engineering with sequence-specific nucleases," Annual Review of Plant Biology May 1, 2013, vol. 64 (pp. 327-350).

Wiles et al., "CRISPR-Cas9-medicated genome editing and guide RNA Design," Mammalian Genome, May 20, 2015, vol. 26, No. 9 (10 pages).

Workman et al., "A natural single-guide RNA repurposes Cas9 to autoregulate CRISPR-Cas expression," Cell Press, vol. 184, Feb. 4, 2021 (pp. 675-688).

Yamada et al., "Crystal Structure of the Minimal Cas9 from Campylobacter jejuni Reveals the Molecular Diversity in the CRISPR-Cas9 Systems," Molecular Cell, vol. 65, Mar. 16, 2017, pp. 1109-1121.

Satterwhite et al., "The BCL11 gene family: involvement of "BCL11A" in lymphoid malignancies," Blood, Neoplasia, vol. 98, No. 12, Dec. 1, 2001 (pp. 3413-3420).

Cutrona et al., "Effects in live cells of a c-myc anti-gene PNA linked to a nuclear localization signal," Nature Biotechnology, Mar. 2000, vol. 18 (pp. 300-303).

Bauer et al., "Fine-Mapping and Genome Editing Reveal an Essential Erythroid Enhancer at the HbF-Associated BCL11A Locus," Blood, Nov. 15, 2013, vol. 122, No. 21 (3 pages).

Bryant et al., "Gene Therapy for Retinal Disease," Review of Ophthalmology, Apr. 5, 2012 (5 pages).

Koller et al., "Inactivating the beta2-microglobulin locus in mouse embryonic stem cells by homologous recombination," Proceedings of the National Academy of Sciences, USA, Nov. 1989, vol. 86 (pp. 8932-8935).

Kugler et al., "Human synapsin 1 gene promoter confers highly neuron-specific long-term transgene expression from an adenoviral vector in the adult rat brain depending on the transduced area," Gene Therapy, 2003, vol. 10 (pp. 337-347).

Li et al., "Genetic correction using engineered nucleases for gene therapy applications," The Japanese Society of Developmental Biologists; Development, Growth & Differentiation, 2014, vol. 56 (pp. 63-77).

Louwen et al., "The Role of CRISPR-Cas Systems in Virulence of Pathogenic Bacteria," Microbiology and Molecular Biology Reviews, Mar. 2014, vol. 78, No. 1 (pp. 74-88).

Reik et al., "Targeted Gene Modification in Hematopoietic Stem Cells: A Potential Treatment for Thalassemia and Sickle Cell Anemia," Blood, American Society of Hematology, Nov. 1, 2013, vol. 122, No. 21 (p. 434).

Riley et al., "Improving the Performance of Cascade Correlation Neural Networks on Multimodal Functions," Proceedings of the World Congress on Engineering 2010 vol. III WCE 2010, Jun. 30-Jul. 2, 2010, London, U.K. (7 pages).

Singleton, "Exome sequencing: a transformative technology," The Lancet/neurology, Oct. 2011, vol. 10 (pp. 942-946).

Xu et al., "Identification of BCL 11 a Structure Function Domains for Fetal Hemoglobin Silencing," Blood, Nov. 15, 2013, vol. 122, No. 21 (4 pages).

David et al., "Non-viral nanosystems for systemic siRNA delivery," Pharmacological Research, 2010, vol. 62 (pp. 100-114).

Gentarget Inc., "CRISPR gRNA lentivector cloning kits," GenTarget Inc., Jan. 1, 2013 (pp. 1-2).

Gjetting et al., "In vitro and in vivo effects of polyethylene glycol (PEG)-modified lipid in DOTAP/cholesterol-mediated gene transfection," International Journal of Nanomedicine, 2010, vol. 5 (pp. 371-383).

Hwang et al., "Efficient genome editing in zebrafish using a CRISPR-Cas system," Nature Biotechnology, Jan. 1, 2013, vol. 31, No. 3, Supplementary Materials (pp. 1-21).

Kocak D. D., "Synthetic Transcription Factors and their Effects on Endogenous DNA Methylation in Human Cells," Thesis Degree of Master of Science, Jan. 1, 2013, Department of Biomedical Engineering Duke University (35 pages).

Bhattacharya et al., "A simple genotyping method to detect small CRISPR-Cas9 induced indels by agarose gel electrophoresis," Scientific Reports, Mar. 14, 2019, vol. 9, No. 4437 (7 pages).

Cameron et al., "Mapping the genomic landscape of CRISPR-Cas9 cleavage," Nature Methods, Jun. 2017, vol. 14, No. 6 (pp. 600-606).

(56) References Cited

OTHER PUBLICATIONS

Raveux et al., "Optimization of the production of knock-in alleles by CRISPR/Cas9 microinjection into the mouse zygote," Scientific Reports, Feb. 17, 2017, vol. 7, No. 42661 (11 pages).
Shapiro et al., "Increasing CRISPR Efficiency and Measuring Its Specificity in HSPCs Using a Clinically Relevant System," Molecular Therapy: Methods & Clinical Development, Jun. 12, 2020, vol. 17 (pp. 1097-1107).
Bethea et al., "Beta2-Microglobulin: Its Significance and Clinical Usefulness," Annals of Clinical and Laboratory Science, vol. 20, No. 3 (pages).
Chen et al., "Cut Site Selection by the Two Nuclease Domains of the Cas9 RNA-guided Endonuclease," The Journal of Biological Chemistry, May 9, 2014, vol. 289, No. 19 (pp. 13284- 13294).
Heidenreich et al., Applications of CRISPR-Cas systems in neuroscience, Nature, Jan. 2016, vol. 17, No. 1 (pp. 35-44).
Huesken et al., "Design of a genome-wide siRNA library using an artificial neural network," Nature Biotechnology, 2006, vol. 23, No. 8 (pp. 995-1001).
Keskin et al., "A new, structurally nonredundant, diverse data set of protein-protein interfaces and its implications", Protein Science, 2004, vol. 13 (pp. 1043-1055).
Magana et al., "Perspectives on gene Therapy in Myotonic Dystrophy Type 1," Journal of Neuroscience research, 2011, vol. 89 (pp. 275-285).
Pakula et al., "Genetic Analysis of Protein Stability and Function," Annual Review of Genetics, Dec. 1989, vol. 23 (pp. 289-310).
Zoghbi et al., "Spinocerebellar ataxia type 1," Seminars in Cell Biology, Feb. 1995, vol. 6, No. 1 (pp. 29-35).

\* cited by examiner

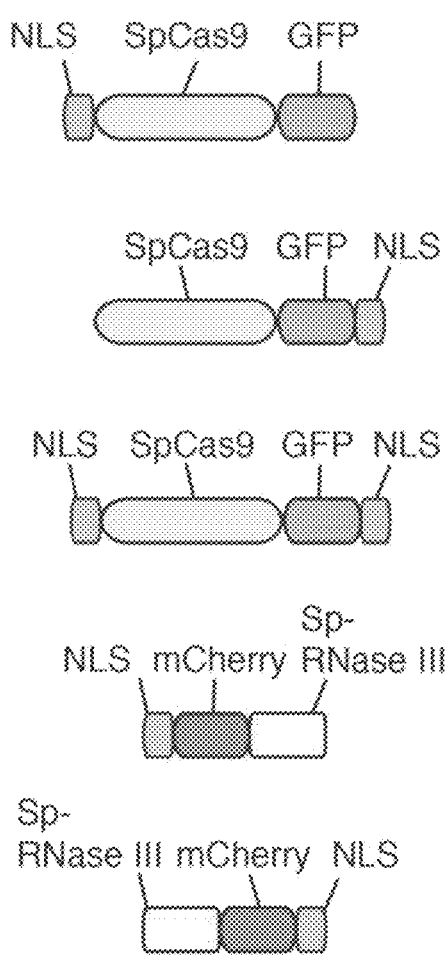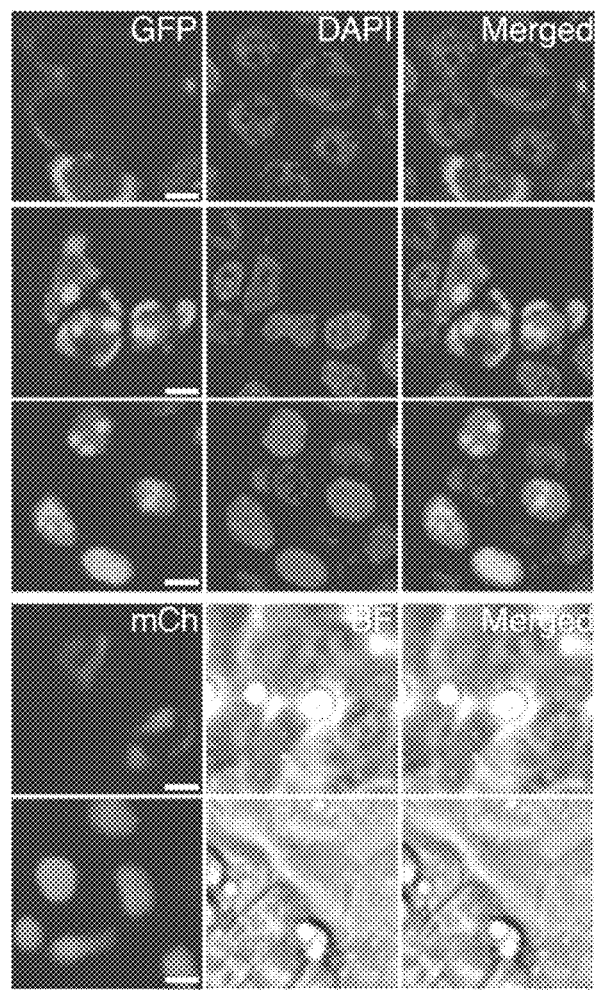
FIG. 2B

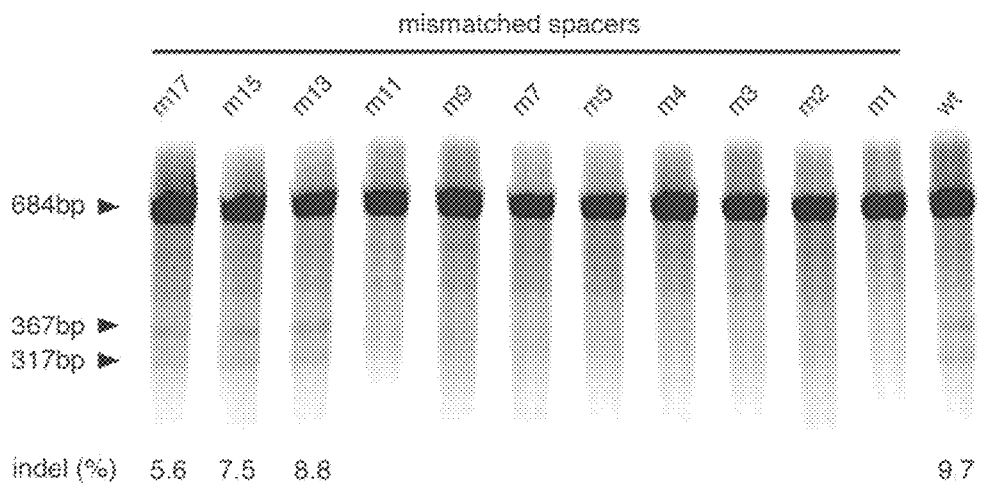

| Cas9 | target species | gene | protospacer ID | protospacer sequence (5' to 3') | PAM | strand | cell line tested | % indel (pre-crRNA + tracrRNA) | % indel (chimeric RNA) |
|---|---|---|---|---|---|---|---|---|---|
| S. pyogenes SF370 type II CRISPR | Homo sapiens | EMX1 | 1 | GGAAGGGCCTGAGTCCGAGCAGAAGAAGAA | CGG | + | 293FT | 20 ± 1.8 | 6.7 ± 0.62 |
| | | EMX1 | 2 | CATTGGAGGTGACATCGATGTCCTCCCCAT | TGG | − | 293FT | 2.1 ± 0.31 | N.D. |
| | | EMX1 | 3 | GGACATCGATGTCACCTCCAATGACTAGGG | TGG | + | 293FT | 14 ± 1.1 | N.D. |
| | | EMX1 | 4 | CATCGATGTCCTCCCCATTGGCCTGCTTCG | TGG | − | 293FT | 11 ± 0.7 | N.D. |
| | | EMX1 | 5 | TTCGTGGCAATGCGCCACCGGTTGATGTGA | TGG | − | 293FT | 4.3 ± 0.48 | 2.1 ± 0.51 |
| | | EMX1 | 6 | TCGTGGCAATGCGCCACCGGTTGATGTGAT | TGG | − | 293FT | 4.0 ± 0.88 | 0.41 ± 0.25 |
| | | EMX1 | 7 | TCCAGCTTCTGCCGTTTGTACTTTGTCCTC | CGG | − | 293FT | 1.5 ± 0.12 | N.D. |
| | | EMX1 | 8 | GGAGGACAAGGCGACACGGAGGATAAACTC | AGG | − | 293FT | 7.8 ± 0.63 | 2.0 ± 1.2 |
| | | PVALB | 9 | AGGGCCGAGATTGGGTGTTCAGGGCAGCAG | AGG | + | 293FT | 2.1 ± 2.6 | 6.5 ± 0.32 |
| | | PVALB | 10 | ATGCAATAGGGTGTGGAAGGCCCGAGAT | TGG | − | 293FT | N.D. | N.D. |
| | | PVALB | 11 | GGTGCGGGCGGAAGAGGGCGAGATTGGGTTC | AGG | + | 293FT | N.D. | N.D. |
| | Mus musculus | Th | 12 | CAAGGACTCAGTGGCCATTACTTAAATGGAT | AGG | − | Neuro2A | 27 ± 4.3 | 4.1 ± 2.2 |
| | | Th | 13 | AATGATAGGGTACCACCCAGTGGCCAC | CGG | − | Neuro2A | 4.6 ± 1.2 | N.D. |
| | | Th | 14 | ACCACACATGGGAAGGTCTTGGCCAGAA | AGG | + | Neuro2A | 11.3 ± 1.3 | N.D. |
| S. thermophilus LMD-9 CRISPR1 | Homo sapiens | EMX1 | 15 | CGGAGGAGTAGTATACAGAAACACAGACAA | GTAGAAT | − | 293FT | 14 ± 0.88 | N.T. |
| | | EMX1 | 16 | AGAATGTACAGAGTCACAAACTCAGCA | CTAGAAA | − | 293FT | 7.9 ± 0.77 | N.T. |

FIG. 5

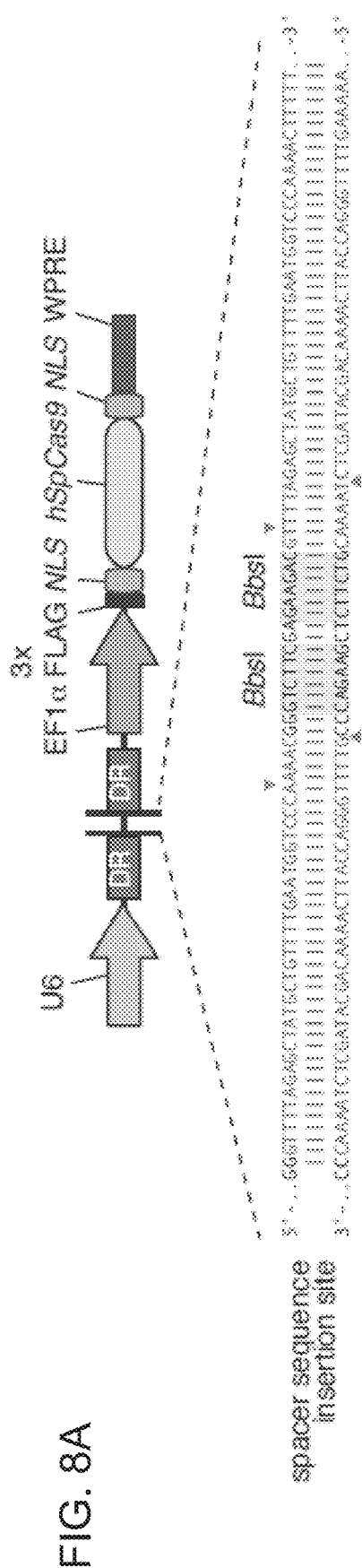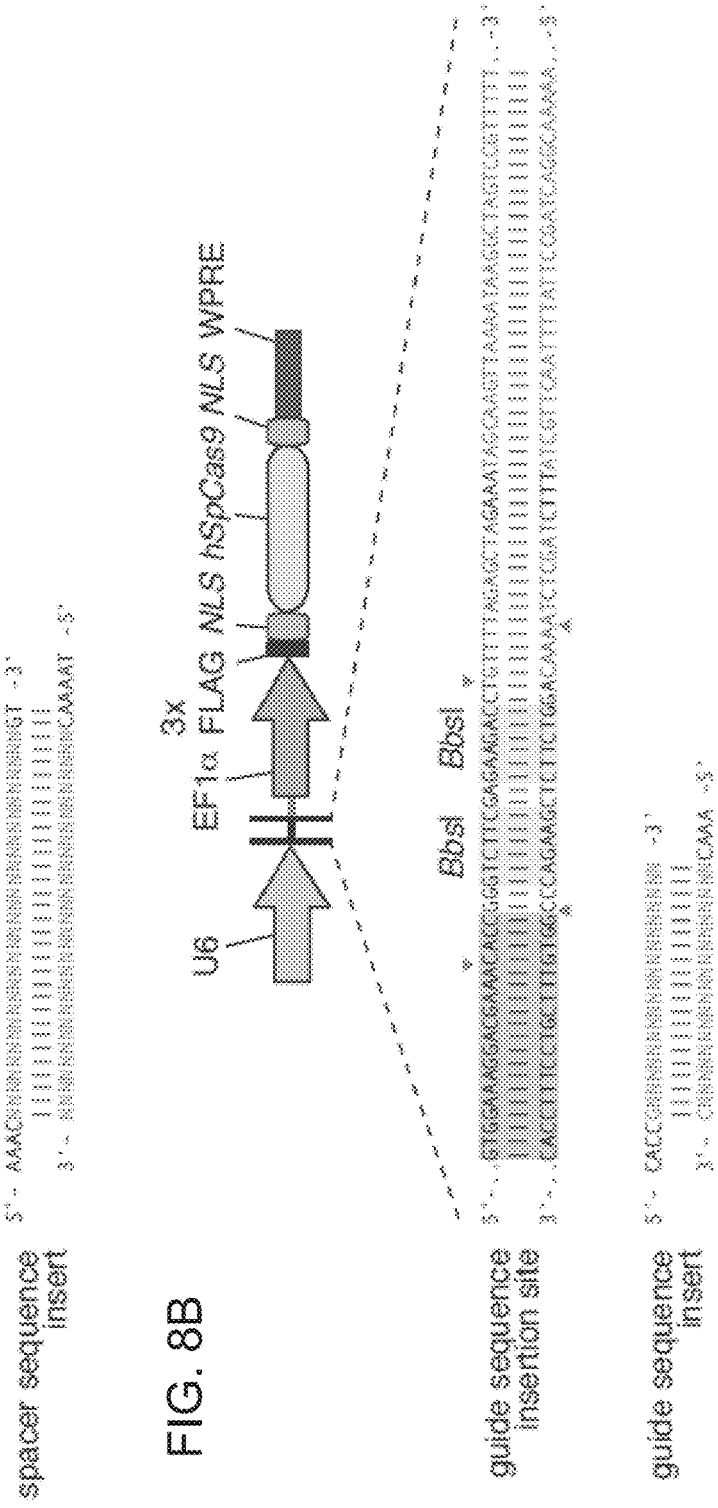
FIG. 8A
FIG. 8B

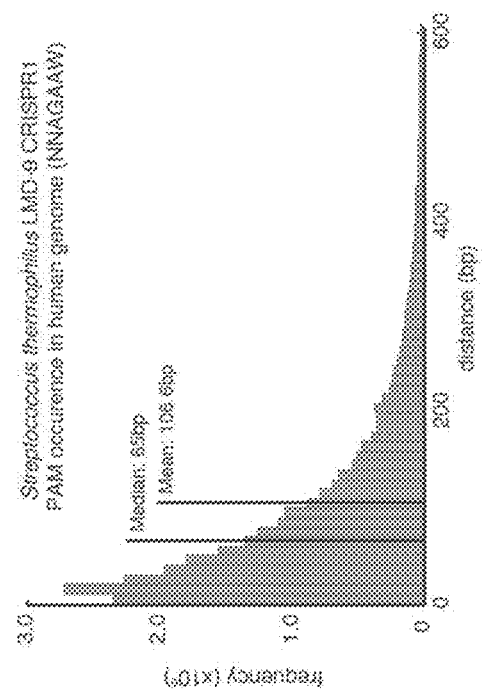
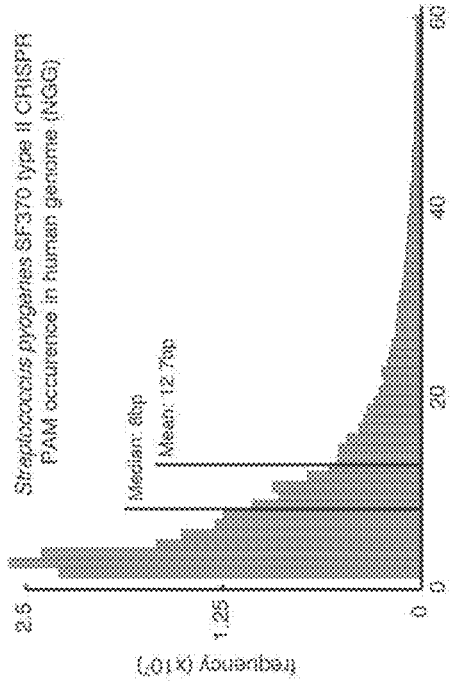
FIG. 9A
FIG. 9B
FIG. 9C

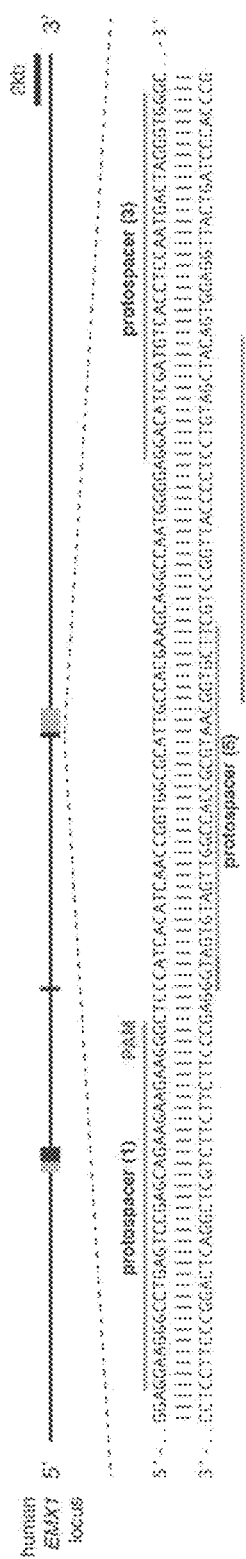
FIG. 11A
FIG. 11B
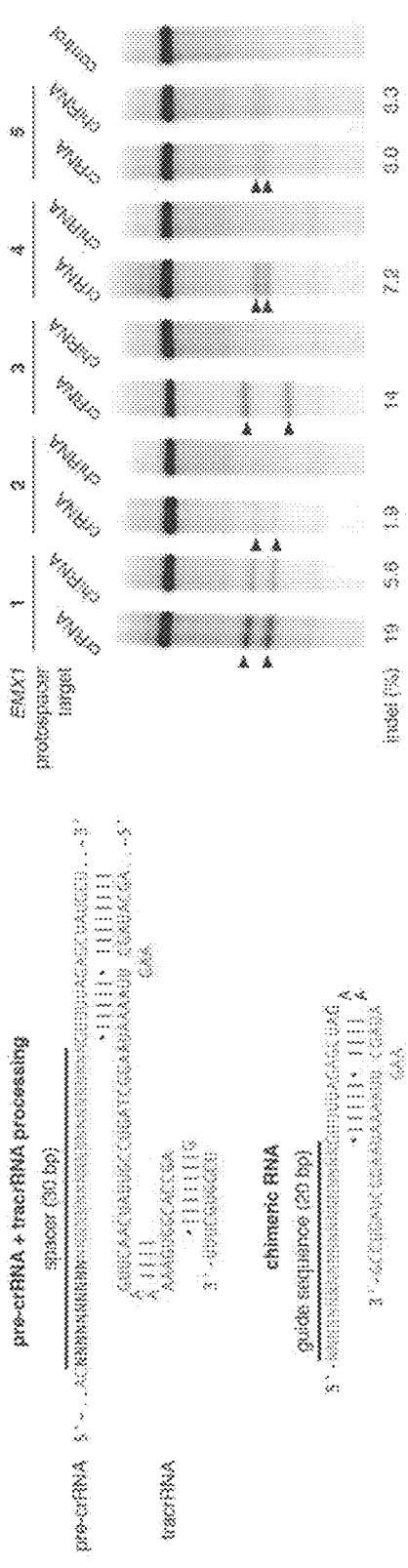
FIG. 11C

| Primer name | Assay | Genomic Target | Primer sequence |
|---|---|---|---|
| Sp-EMX1-F | SURVEYOR assay, sequencing | EMX1 | AAAACCACCCTTCTCTCTGGC |
| Sp-EMX1-R | SURVEYOR assay, sequencing | EMX1 | GGAGATTGGAGACACGGAGAG |
| Sp-PVALB-F | SURVEYOR assay, sequencing | PVALB | CTGGAAAGCCAATGCCTGAC |
| Sp-PVALB-R | SURVEYOR assay, sequencing | PVALB | GGCAGCAAACTCCTTGTCCT |
| Sp-Th-F | SURVEYOR assay, sequencing | Th | GTGCTTTGCAGAGGCCTACC |
| Sp-Th-R | SURVEYOR assay, sequencing | Th | CCTGGAGCGCATGCAGTAGT |
| St-EMX1-F | SURVEYOR assay, sequencing | EMX1 | ACCTTCTGTGTTTCCACCATTC |
| St-EMX1-R | SURVEYOR assay, sequencing | EMX1 | TTGGGGAGTGCACAGACTTC |
| Sp-EMX1-RFLP-F | RFLP, sequencing | EMX1 | GGCTCCCTGGGTTCAAAGTA |
| Sp-EMX1-RFLP-R | RFLP, sequencing | EMX1 | AGAGGGGTCTGGATGTCGTAA |
| Pb_EMX1_sp1 | Northern Blot Probe | Not applicable | TAGCTCTAAAACTTCTTCTTCTGCTCGGAC |
| Pb_tracrRNA | Northern Blot Probe | Not applicable | CTAGCCTTATTTTAACTTGCTATGCTGTTT |

FIG. 20B hSpCas9

```
5'  CTGGAAGAGTCCTTCCTGGTGGAAGAGGATAAGAAGCACGAGCGGCACCCCATCTTCGGC
                                                                    360
         L   E   E   S   F   L   V   E   E   D   K   K   H   E   R   H   P   I   F   G
        101 102 103 104 105 106 107 108 109 110 111 112 113 114 115 116 117 118 119 120

5'  AACATCGTGGACGAGGTGGCCTACCACGAGAAGTACCCCACCATCTACCACCTGAGAAAG
                                                                    420
         N   I   V   D   E   V   A   Y   H   E   K   Y   P   T   I   Y   H   L   R   K
        121 122 123 124 125 126 127 128 129 130 131 132 133 134 135 136 137 138 139 140

5'  AAACTGGTGGACAGCACCGACAAGGCCGACCTGCGGCTGATCTATCTGGCCCTGGCCCAC
                                                                    480
         K   L   V   D   S   T   D   K   A   D   L   R   L   I   Y   L   A   L   A   H
        141 142 143 144 145 146 147 148 149 150 151 152 153 154 155 156 157 158 159 160

5'  ATGATCAAGTTCCGGGGCCACTTCCTGATCGAGGGCGACCTGAACCCCGACAACAGCGAC
                                                                    540
         M   I   K   F   R   G   H   F   L   I   E   G   D   L   N   P   D   N   S   D
        161 162 163 164 165 166 167 168 169 170 171 172 173 174 175 176 177 178 179 180

5'  GTGGACAAGCTGTTCATCCAGCTGGTGCAGACCTACAACCAGCTGTTCGAGGAAAACCCC
                                                                    600
         V   D   K   L   F   I   Q   L   V   Q   T   Y   N   Q   L   F   E   E   N   P
        181 182 183 184 185 186 187 188 189 190 191 192 193 194 195 196 197 198 199 200

5'  ATCAACGCCAGCGGCGTGGACGCCAAGGCCATCCTGTCTGCCAGACTGAGCAAGAGCAGA
                                                                    660
         I   N   A   S   G   V   D   A   K   A   I   L   S   A   R   L   S   K   S   R
        201 202 203 204 205 206 207 208 209 210 211 212 213 214 215 216 217 218 219 220
```

FIG. 24B hSpCas9

```
5' CGGCTGGAAAATCTGATCGCCCAGCTGCCCGGCGAGAAGAAGAATGGCCTGTTCGGCAAC
                                                                    720
      R  L  E  N  L  I  A  Q  L  P  G  E  K  K  N  G  L  F  G  N
     221 222 223 224 225 226 227 228 229 230 231 232 233 234 235 236 237 238 239 240

5' CTGATTGCCCTGAGCCTGGGCCTGACCCCCAACTTCAAGAGCAACTTCGACCTGGCCGAG
                                                                    780
      L  I  A  L  S  L  G  L  T  P  N  F  K  S  N  F  D  L  A  E
     241 242 243 244 245 246 247 248 249 250 251 252 253 254 255 256 257 258 259 260

5' GATGCCAAACTGCAGCTGAGCAAGGACACCTACGACGACGACCTGGACAACCTGCTGGCC
                                                                    840
      D  A  K  L  Q  L  S  K  D  T  Y  D  D  D  L  D  N  L  L  A
     261 262 263 264 265 266 267 268 269 270 271 272 273 274 275 276 277 278 279 280

5' CAGATCGGCGACCAGTACGCCGACCTGTTTCTGGCCGCCAAGAACCTGTCCGACGCCATC
                                                                    900
      Q  I  G  D  Q  Y  A  D  L  F  L  A  A  K  N  L  S  D  A  I
     281 282 283 284 285 286 287 288 289 290 291 292 293 294 295 296 297 298 299 300

5' CTGCTGAGCGACATCCTGAGAGTGAACACCGAGATCACCAAGGCCCCCCTGAGCGCCTCT
                                                                    960
      L  L  S  D  I  L  R  V  N  T  E  I  T  K  A  P  L  S  A  S
     301 302 303 304 305 306 307 308 309 310 311 312 313 314 315 316 317 318 319 320

5' ATGATCAAGAGATACGACGAGCACCACCAGGACCTGACCCTGCTGAAAGCTCTCGTGCGG
                                                                    1020
      M  I  K  R  Y  D  E  H  H  Q  D  L  T  L  L  K  A  L  V  R
     321 322 323 324 325 326 327 328 329 330 331 332 333 334 335 336 337 338 339 340
```

FIG. 24C hSpCas9

```
5' CAGCAGCTGCCTGAGAAGTACAAAGAGATTTTCTTCGACCAGAGCAAGAACGGCTACGCC 1080
       Q  Q  L  P  E  K  Y  K  E  I  F  F  D  Q  S  K  N  G  Y  A
      341 342 343 344 345 346 347 348 349 350 351 352 353 354 355 356 357 358 359 360

5' GGCTACATTGACGGCGGAGCCAGCCAGGAAGAGTTCTACAAGTTCATCAAGCCCATCCTG 1140
       G  Y  I  D  G  G  A  S  Q  E  E  F  Y  K  F  I  K  P  I  L
      361 362 363 364 365 366 367 368 369 370 371 372 373 374 375 376 377 378 379 380

5' GAAAAGATGGACGGCACCGAGGAACTGCTCGTGAAGCTGAACAGAGAGGACCTGCTGCGG 1200
       E  K  M  D  G  T  E  E  L  L  V  K  L  N  R  E  D  L  L  R
      381 382 383 384 385 386 387 388 389 390 391 392 393 394 395 396 397 398 399 400

5' AAGCAGCGGACCTTCGACAACGGCAGCATCCCCCACCAGATCCACCTGGGAGAGCTGCAC 1260
       K  Q  R  T  F  D  N  G  S  I  P  H  Q  I  H  L  G  E  L  H
      401 402 403 404 405 406 407 408 409 410 411 412 413 414 415 416 417 418 419 420

5' GCCATTCTGCGGCGGCAGGAAGATTTTTACCCATTCCTGAAGGACAACCGGGAAAAGATC 1320
       A  I  L  R  R  Q  E  D  F  Y  P  F  L  K  D  N  R  E  K  I
      421 422 423 424 425 426 427 428 429 430 431 432 433 434 435 436 437 438 439 440

5' GAGAAGATCCTGACCTTCCGCATCCCCTACTACGTGGGCCCTCTGGCCAGGGGAAACAGC 1380
       E  K  I  L  T  F  R  I  P  Y  Y  V  G  P  L  A  R  G  N  S
      441 442 443 444 445 446 447 448 449 450 451 452 453 454 455 456 457 458 459 460
```

FIG. 24D hSpCas9

```
5'  AGATTCGCCTGGATGACCAGAAAGAGCGAGGAAACCATCACCCCCTGGAACTTCGAGGAA
                                                                          1440
        R   F   A   W   M   T   R   K   S   E   E   T   I   T   P   W   N   F   E   E
       461 462 463 464 465 466 467 468 469 470 471 472 473 474 475 476 477 478 479 480

5'  GTGGTGGACAAGGGCGCTTCCGCCCAGAGCTTCATCGAGCGGATGACCAACTTCGATAAG
                                                                          1500
        V   V   D   K   G   A   S   A   Q   S   F   I   E   R   M   T   N   F   D   K
       481 482 483 484 485 486 487 488 489 490 491 492 493 494 495 496 497 498 499 500

5'  AACCTGCCCAACGAGAAGGTGCTGCCCAAGCACAGCCTGCTGTACGAGTACTTCACCGTG
                                                                          1560
        N   L   P   N   E   K   V   L   P   K   H   S   L   L   Y   E   Y   F   T   V
       501 502 503 504 505 506 507 508 509 510 511 512 513 514 515 516 517 518 519 520

5'  TATAACGAGCTGACCAAAGTGAAATACGTGACCGAGGGAATGAGAAAGCCCGCCTTCCTG
                                                                          1620
        Y   N   E   L   T   K   V   K   Y   V   T   E   G   M   R   K   P   A   F   L
       521 522 523 524 525 526 527 528 529 530 531 532 533 534 535 536 537 538 539 540

5'  AGCGGCGAGCAGAAAAAGGCCATCGTGGACCTGCTGTTCAAGACCAACCGGAAAGTGACC
                                                                          1680
        S   G   E   Q   K   K   A   I   V   D   L   L   F   K   T   N   R   K   V   T
       541 542 543 544 545 546 547 548 549 550 551 552 553 554 555 556 557 558 559 560

5'  GTGAAGCAGCTGAAAGAGGACTACTTCAAGAAAATCGAGTGCTTCGACTCCGTGGAAATC
                                                                          1740
        V   K   Q   L   K   E   D   Y   F   K   K   I   E   C   F   D   S   V   E   I
       561 562 563 564 565 566 567 568 569 570 571 572 573 574 575 576 577 578 579 580
```

FIG. 24E hSpCas9

```
5' TCCGGCGTGGAAGATCGGTTCAACGCCTCCCTGGGCACATACCACGATCTGCTGAAAATT
                                                                    1800
    S  G  V  E  D  R  F  N  A  S  L  G  T  Y  H  D  L  L  K  I
    581 582 583 584 585 586 587 588 589 590 591 592 593 594 595 596 597 598 599 600

5' ATCAAGGACAAGGACTTCCTGGACAATGAGGAAAACGAGGACATTCTGGAAGATATCGTG
                                                                    1860
    I  K  D  K  D  F  L  D  N  E  E  N  E  D  I  L  E  D  I  V
    601 602 603 604 605 606 607 608 609 610 611 612 613 614 615 616 617 618 619 620

5' CTGACCCTGACACTGTTTGAGGACAGAGAGATGATCGAGGAACGGCTGAAAACCTATGCC
                                                                    1920
    L  T  L  T  L  F  E  D  R  E  M  I  E  E  R  L  K  T  Y  A
    621 622 623 624 625 626 627 628 629 630 631 632 633 634 635 636 637 638 639 640

5' CACCTGTTCGACGACAAAGTGATGAAGCAGCTGAAGCGGCGGAGATACACCGGCTGGGGC
                                                                    1980
    H  L  F  D  D  K  V  M  K  Q  L  K  R  R  R  Y  T  G  W  G
    641 642 643 644 645 646 647 648 649 650 651 652 653 654 655 656 657 658 659 660

5' AGGCTGAGCCGGAAGCTGATCAACGGCATCCGGGACAAGCAGTCCGGCAAGACAATCCTG
                                                                    2040
    R  L  S  R  K  L  I  N  G  I  R  D  K  Q  S  G  K  T  I  L
    661 662 663 664 665 666 667 668 669 670 671 672 673 674 675 676 677 678 679 680

5' GATTTCCTGAAGTCCGACGGCTTCGCCAACAGAAACTTCATGCAGCTGATCCACGACGAC
                                                                    2100
    D  F  L  K  S  D  G  F  A  N  R  N  F  M  Q  L  I  H  D  D
    681 682 683 684 685 686 687 688 689 690 691 692 693 694 695 696 697 698 699 700
```

FIG. 24F

FIG. 24G hSpCas9

```
5' GTGGAAAACACCCAGCTGCAGAACGAGAAGCTGTACCTGTACTACCTGCAGAATGGGCGG 2460
```
hSpCas9
V E N T Q L Q N E K L Y L Y Y L Q N G R
801 802 803 804 805 806 807 808 809 810 811 812 813 814 815 816 817 818 819 820

```
5' GATATGTACGTGGACCAGGAACTGGACATCAACCGGCTGTCCGACTACGATGTGGACGCC 2520
```
hSpCas9
HNH
H
D M Y V D Q E L D I N R L S D Y D V D A
821 822 823 824 825 826 827 828 829 830 831 832 833 834 835 836 837 838 839 840

```
5' ATCGTGCCTCAGAGCTTTCTGAAGGACGACTCCATCGACGCCAAGGTGCTGACCAGAAGC 2580
```
hSpCas9
HNH
H
I V P Q S F L K D D S I D A K V L T R S
841 842 843 844 845 846 847 848 849 850 851 852 853 854 855 856 857 858 859 860

```
5' GACAAGGCCCGGGGCAAGAGCGACAACGTGCCCTCCGAAGAGGTCGTGAAGAAGATGAAG 2640
```
hSpCas9
HNH
H
D K A R G K S D N V P S E E V V K K M K
861 862 863 864 865 866 867 868 869 870 871 872 873 874 875 876 877 878 879 880

```
5' AACTACTGGCGGCAGCTGCTGAACGCCAAGCTGATTACCCAGAGAAAGTTCGACAATCTG 2700
```
hSpCas9
N Y W R Q L L N A K L I T Q R K F D N L
881 882 883 884 885 886 887 888 889 890 891 892 893 894 895 896 897 898 899 900

FIG. 24H

```
hSpCas9
5'  ACCAAGGCCGAGAGAGGCGGCCTGAGCGAACTGGATAAGGCCGGCTTCATCAAGAGACAG
                                                                              2760
                              hSpCas9
    T  K  A  E  R  G  G  L  S  E  L  D  K  A  G  F  I  K  R  Q
    901 902 903 904 905 906 907 908 909 910 911 912 913 914 915 916 917 918 919 920

5'  CTGGTGGAAACCCGGCAGATCACAAAGCACGTGGCACAGATCCTGGACTCCCGGATGAAC
                                                                              2820
                              hSpCas9
    L  V  E  T  R  Q  I  T  K  H  V  A  Q  I  L  D  S  R  M  N
    921 922 923 924 925 926 927 928 929 930 931 932 933 934 935 936 937 938 939 940

5'  ACTAAGTACGACGAGAATGACAAGCTGATCCGGGAAGTGAAAGTGATCACCCTGAAGTCC
                                                                              2880
                              hSpCas9
    T  K  Y  D  E  N  D  K  L  I  R  E  V  K  V  I  T  L  K  S
    941 942 943 944 945 946 947 948 949 950 951 952 953 954 955 956 957 958 959 960

5'  AAGCTGGTGTCCGATTTCCGGAAGGATTTCCAGTTTTACAAAGTGCGCGAGATCAACAAC
                                                                              2940
                              hSpCas9
    K  L  V  S  D  F  R  K  D  F  Q  F  Y  K  V  R  E  I  N  N
    961 962 963 964 965 966 967 968 969 970 971 972 973 974 975 976 977 978 979 980

5'  TACCACCACGCCCACGCCGCCTACCTGAACGCCGTCGTGGGAACCGCCCTGATCAAAAAG
                                                                              3000
                              hSpCas9
                    RuvC III
                       8
    Y  H  H  A  H  A  A  Y  L  N  A  V  V  G  T  A  L  I  K  K
    981 982 983 984 985 986 987 988 989 990 991 992 993 994 995 996 997 998 999 1000
```

FIG. 24I hSpCas9

```
5'  TACCCTAAGCTGGAAAGCGAGTTCGTGTACGGCGACTACAAGGTGTACGACGTGCGGAAG
                                                                      3060
       Y  P  K  L  E  S  E  F  V  Y  G  D  Y  K  V  Y  D  V  R  K
      1001 1002 1003 1004 1005 1006 1007 1008 1009 1010 1011 1012 1013 1014 1015 1016 1017 1018 1019 1020

5'  ATGATCGCCAAGAGCGAGCAGGAAATCGGCAAGGCTACCGCCAAGTACTTCTTCTACAGC
                                                                      3120
       M  I  A  K  S  E  Q  E  I  G  K  A  T  A  K  Y  F  F  Y  S
      1021 1022 1023 1024 1025 1026 1027 1028 1029 1030 1031 1032 1033 1034 1035 1036 1037 1038 1039 1040

5'  AACATCATGAACTTTTTCAAGACCGAGATTACCCTGGCCAACGGCGAGATCCGGAAGCGG
                                                                      3180
       N  I  M  N  F  F  K  T  E  I  T  L  A  N  G  E  I  R  K  R
      1041 1042 1043 1044 1045 1046 1047 1048 1049 1050 1051 1052 1053 1054 1055 1056 1057 1058 1059 1060

5'  CCTCTGATCGAGACAAACGGCGAAACCGGGGAGATCGTGTGGGATAAGGGCCGGGATTTT
                                                                      3240
       P  L  I  E  T  N  G  E  T  G  E  I  V  W  D  K  G  R  D  F
      1061 1062 1063 1064 1065 1066 1067 1068 1069 1070 1071 1072 1073 1074 1075 1076 1077 1078 1079 1080

5'  GCCACCGTGCGGAAAGTGCTGAGCATGCCCCAAGTGAATATCGTGAAAAAGACCGAGGTG
                                                                      3300
       A  T  V  R  K  V  L  S  M  P  Q  V  N  I  V  K  K  T  E  V
      1081 1082 1083 1084 1085 1086 1087 1088 1089 1090 1091 1092 1093 1094 1095 1096 1097 1098 1099 1100

5'  CAGACAGGCGGCTTCAGCAAAGAGTCTATCCTGCCCAAGAGGAACAGCGATAAGCTGATC
                                                                      3360
       Q  T  G  G  F  S  K  E  S  I  L  P  K  R  N  S  D  K  L  I
      1101 1102 1103 1104 1105 1106 1107 1108 1109 1110 1111 1112 1113 1114 1115 1116 1117 1118 1119 1120
```

FIG. 24J hSpCas9

```
5' GCCAGAAAGAAGGACTGGGACCCTAAGAAGTACGGCGGCTTCGACAGCCCCACCGTGGCC
                                    hSpCas9
    A   R   K   K   D   W   D   P   K   K   Y   G   G   F   D   S   P   T   V   A
   1121 1122 1123 1124 1125 1126 1127 1128 1129 1130 1131 1132 1133 1134 1135 1136 1137 1138 1139 1140
```
3420

```
5' TATTCTGTGCTGGTGGTGGCCAAAGTGGAAAAGGGCAAGTCCAAGAAACTGAAGAGTGTG
                                    hSpCas9
    Y   S   V   L   V   V   A   K   V   E   K   G   K   S   K   K   L   K   S   V
   1141 1142 1143 1144 1145 1146 1147 1148 1149 1150 1151 1152 1153 1154 1155 1156 1157 1158 1159 1160
```
3480

```
5' AAAGAGCTGCTGGGGATCACCATCATGGAAAGAAGCAGCTTCGAGAAGAATCCCATCGAC
                                    hSpCas9
    K   E   L   L   G   I   T   I   M   E   R   S   S   F   E   K   N   P   I   D
   1161 1162 1163 1164 1165 1166 1167 1168 1169 1170 1171 1172 1173 1174 1175 1176 1177 1178 1179 1180
```
3540

```
5' TTTCTGGAAGCCAAGGGCTACAAAGAAGTGAAAAAGGACCTGATCATCAAGCTGCCTAAG
                                    hSpCas9
    F   L   E   A   K   G   Y   K   E   V   K   K   D   L   I   I   K   L   P   K
   1181 1182 1183 1184 1185 1186 1187 1188 1189 1190 1191 1192 1193 1194 1195 1196 1197 1198 1199 1200
```
3600

```
5' TACTCCCTGTTCGAGCTGGAAAACGGCCGGAAGAGAATGCTGGCCTCTGCCGGCGAACTG
                                    hSpCas9
    Y   S   L   F   E   L   E   N   G   R   K   R   M   L   A   S   A   G   E   L
   1201 1202 1203 1204 1205 1206 1207 1208 1209 1210 1211 1212 1213 1214 1215 1216 1217 1218 1219 1220
```
3660

```
5' CAGAAGGGAAACGAACTGGCCCTGCCCTCCAAATATGTGAACTTCCTGTACCTGGCCAGC
                                    hSpCas9
    Q   K   G   N   E   L   A   L   P   S   K   Y   V   N   F   L   Y   L   A   S
   1221 1222 1223 1224 1225 1226 1227 1228 1229 1230 1231 1232 1233 1234 1235 1236 1237 1238 1239 1240
```
3720

FIG. 24K hSpCas9

```
5' CACTATGAGAAGCTGAAGGGCTCCCCCGAGGATAATGAGCAGAAACAGCTGTTTGTGGAA 3780
    ++++++++++++++++++++++++++++++++++++++++++++++++++++++++++++
    [hSpCas9]
     H   Y   E   K   L   K   G   S   P   E   D   N   E   Q   K   Q   L   F   V   E
    1241 1242 1243 1244 1245 1246 1247 1248 1249 1250 1251 1252 1253 1254 1255 1256 1257 1258 1259 1260

5' CAGCACAAGCACTACCTGGACGAGATCATCGAGCAGATCAGCGAGTTCTCCAAGAGAGTG 3840
    ++++++++++++++++++++++++++++++++++++++++++++++++++++++++++++
    [hSpCas9]
     Q   H   K   H   Y   L   D   E   I   I   E   Q   I   S   E   F   S   K   R   V
    1261 1262 1263 1264 1265 1266 1267 1268 1269 1270 1271 1272 1273 1274 1275 1276 1277 1278 1279 1280

5' ATCCTGGCCGACGCTAATCTGGACAAAGTGCTGTCCGCCTACAACAAGCACCGGGATAAG 3900
    ++++++++++++++++++++++++++++++++++++++++++++++++++++++++++++
    [hSpCas9]
     I   L   A   D   A   N   L   D   K   V   L   S   A   Y   N   K   H   R   D   K
    1281 1282 1283 1284 1285 1286 1287 1288 1289 1290 1291 1292 1293 1294 1295 1296 1297 1298 1299 1300

5' CCCATCAGAGAGCAGGCCGAGAATATCATCCACCTGTTTACCCTGACCAATCTGGGAGCC 3960
    ++++++++++++++++++++++++++++++++++++++++++++++++++++++++++++
    [hSpCas9]
     P   I   R   E   Q   A   E   N   I   I   H   L   F   T   L   T   N   L   G   A
    1301 1302 1303 1304 1305 1306 1307 1308 1309 1310 1311 1312 1313 1314 1315 1316 1317 1318 1319 1320

5' CCTGCCGCCTTCAAGTACTTTGACACCACCATCGACCGGAAGAGGTACACCAGCACCAAA 4020
    ++++++++++++++++++++++++++++++++++++++++++++++++++++++++++++
    [hSpCas9]
     P   A   A   F   K   Y   F   D   T   T   I   D   R   K   R   Y   T   S   T   K
    1321 1322 1323 1324 1325 1326 1327 1328 1329 1330 1331 1332 1333 1334 1335 1336 1337 1338 1339 1340

5' GAGGTGCTGGACGCCACCCTGATCCACCAGAGCATCACCGGCCTGTACGAGACACGGATC 4080
    ++++++++++++++++++++++++++++++++++++++++++++++++++++++++++++
    [hSpCas9]
     E   V   L   D   A   T   L   I   H   Q   S   I   T   G   L   Y   E   T   R   I
    1341 1342 1343 1344 1345 1346 1347 1348 1349 1350 1351 1352 1353 1354 1355 1356 1357 1358 1359 1360
```

FIG. 24L

Cas9 Expression in Mouse Hippocampus (AAV)
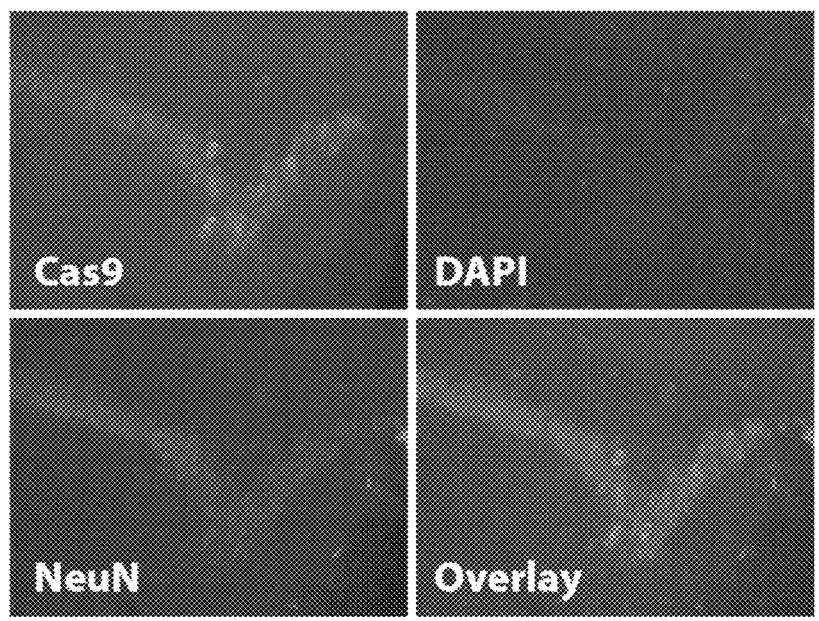
Cas9 Expression in Mouse Cortex (AAV)
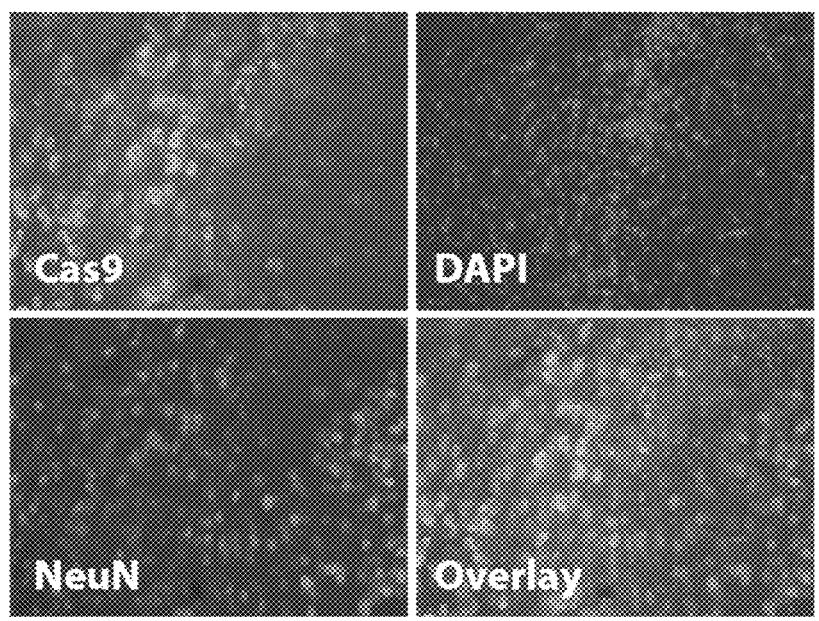
FIG. 27

FIG. 28A
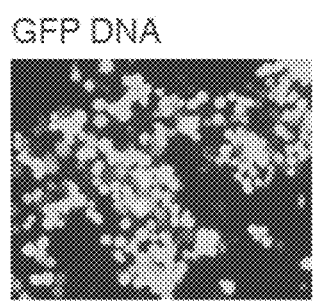
GFP DNA
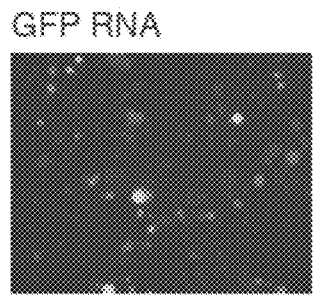
GFP RNA
FIG. 28B
FIG. 28C
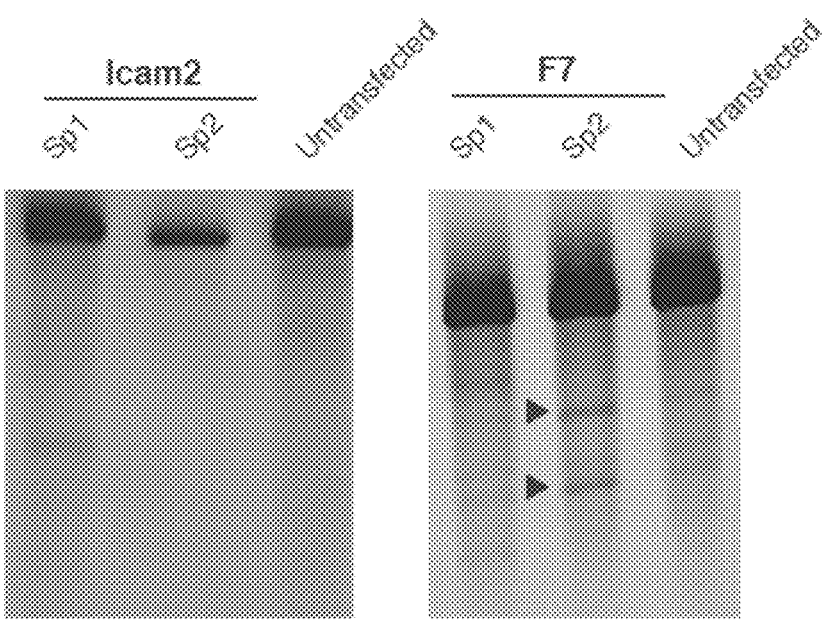

Repair Strategy for Cystic Fibrosis deltaF508 Mutation

1. human CFTR genomic locus 2. human CFTRdelta508-targeting chimeric guide RNA 3. repair template for deltaF508 mutation

FIG. 32A-B

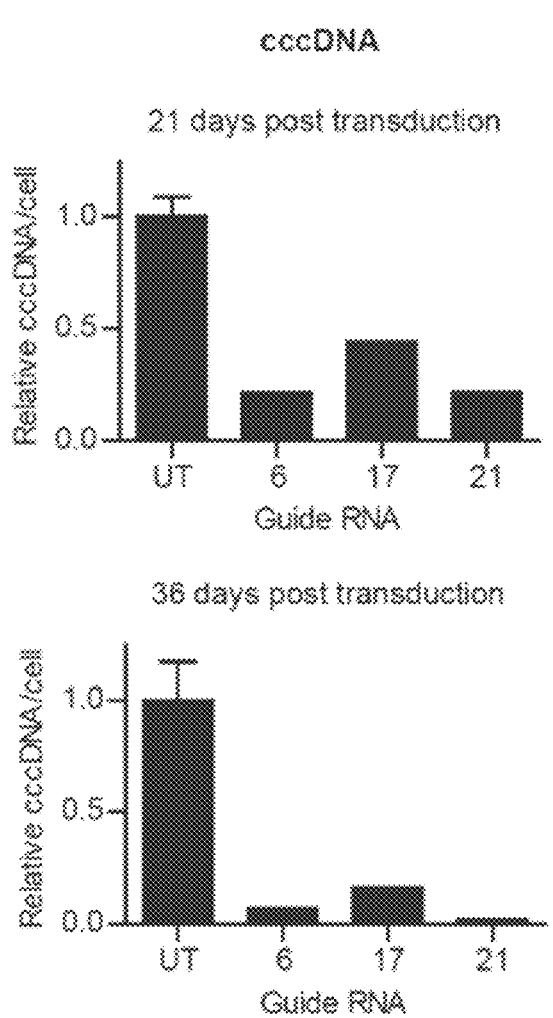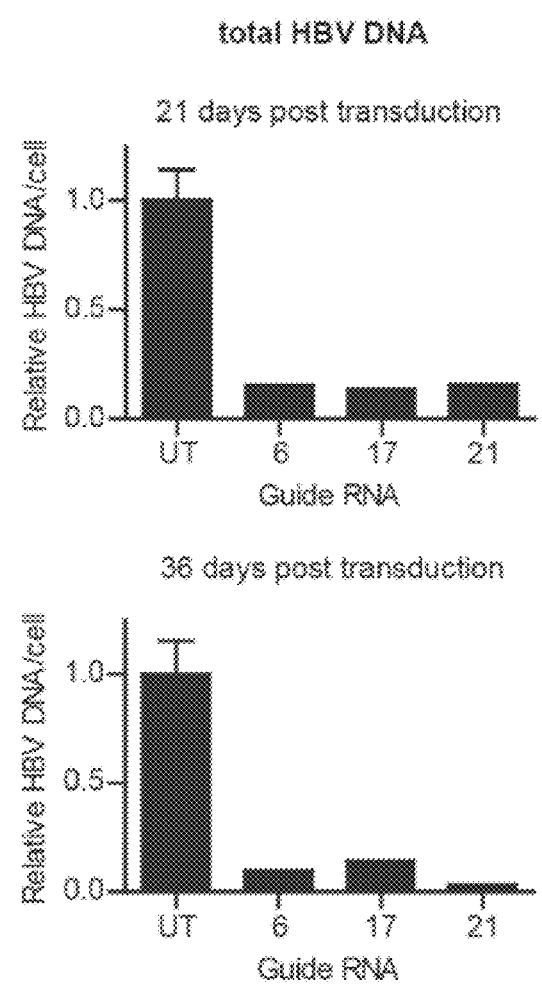

DELIVERY, USE AND THERAPEUTIC APPLICATIONS OF THE CRISPR-CAS SYSTEMS AND COMPOSITIONS FOR HBV AND VIRAL DISEASES AND DISORDERS

RELATED APPLICATIONS AND INCORPORATION BY REFERENCE

This application a Continuation of U.S. application Ser. No. 15/179,938, filed on Jun. 10, 2016, which is a Continuation-in-Part of International Application Number PCT/US14/70135, filed on Dec. 12, 2014, which published as PCT Publication No. WO2015/089465 on Jun. 18, 2015. This application claims priority from U.S. provisional application 61/915,301, filed Dec. 12, 2013, and U.S. provisional application 62/010,329, filed Jun. 10, 2014.

The foregoing application(s), and all documents cited therein or during its or their prosecution ("appln cited documents") and all documents cited or referenced in the appln cited documents, and all documents cited or referenced herein ("herein cited documents"), and all documents cited or referenced in herein cited documents, together with any manufacturer's instructions, descriptions, product specifications, and product sheets for any products mentioned herein or in any document incorporated by reference herein, are hereby incorporated herein by reference, and may be employed in the practice of the invention. More specifically, all referenced documents are incorporated by reference to the same extent as if each individual document was specifically and individually indicated to be incorporated by reference.

STATEMENT AS TO FEDERALLY SPONSORED RESEARCH

This invention was made with government support under Grant No. M100706 awarded by the National Institutes of Health. The government has certain rights in the invention.

SEQUENCE LISTING

The instant application contains a Sequence Listing which has been submitted electronically in ASCII format and is hereby incorporated by reference in its entirety. Said ASCII copy created on Jun. 8, 2016, is named 47627.03.2050_SL.txt is 525,868 bytes in size.

FIELD OF THE INVENTION

The present invention generally relates to the delivery, engineering, optimization and therapeutic applications of systems, methods, and compositions used for the control of gene expression involving sequence targeting, such as genome perturbation or gene-editing, that relate to Clustered Regularly Interspaced Short Palindromic Repeats (CRISPR) and components thereof.

BACKGROUND OF THE INVENTION

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that are affordable, easy to set up, scalable, and amenable to targeting multiple positions within the eukaryotic genome.

SUMMARY OF THE INVENTION

The CRISPR-Cas system does not require the generation of customized proteins to target specific sequences but rather a single Cas enzyme can be programmed by a short RNA molecule to recognize a specific DNA target. Adding the CRISPR-Cas system to the repertoire of genome sequencing techniques and analysis methods may significantly simplify the methodology and accelerate the ability to catalog and map genetic factors associated with a diverse range of biological functions and diseases. To utilize the CRISPR-Cas system effectively for genome editing without deleterious effects, it is critical to understand aspects of engineering, optimization and cell-type/tissue/organ specific delivery of these genome engineering tools, which are aspects of the claimed invention.

There exists a pressing need for alternative and robust systems and techniques for nucleic sequence targeting with a wide array of applications. Aspects of this invention address this need and provide related advantages, particularly in relation to treatment of viral infections which persist due to integration of a virus into a host's genome and/or by maintenance of an episomal form (e.g. hepatitis B virus, HBV, which maintains extraordinary persistence in the nucleus of human hepatocytes by means of a long-lived episomal double-stranded DNA form called covalent closed circular DNA, or cccDNA). Applicants have shown that it is possible to directly cleave and reduce the abundance of this episomal form of the virus (cccDNA: a dsDNA structure that arises during the propagation of HBV in the cell nucleus and can remain permanently present in infected subjects).

An exemplary CRISPR complex comprises a CRISPR enzyme complexed with a guide sequence hybridized or hybridizable to a target sequence within the target polynucleotide. The guide sequence is linked to a tracr mate sequence, which in turn hybridizes to a tracr sequence.

In one aspect, the invention provides methods for using one or more elements of a CRISPR-Cas system. The CRISPR complex of the invention provides an effective means for modifying a target polynucleotide. The CRISPR complex of the invention has a wide variety of utilities including modifying (e.g., deleting, inserting, translocating, inactivating, activating) a target polynucleotide in a multiplicity of cell types in various tissues and organs. As such the CRISPR complex of the invention has a broad spectrum of applications in, e.g., gene or genome editing, gene therapy, drug discovery, drug screening, disease diagnosis, and prognosis.

Aspects of the invention relate to Cas9 enzymes having improved targeting specificity in a CRISPR-Cas9 system having guide RNAs having optimal activity, smaller in length than wild-type Cas9 enzymes and nucleic acid molecules coding therefor, and chimeric Cas9 enzymes, as well as methods of improving the target specificity of a Cas9 enzyme or of designing a CRISPR-Cas9 system comprising designing or preparing guide RNAs having optimal activity and/or selecting or preparing a Cas9 enzyme having a smaller size or length than wild-type Cas9 whereby packaging a nucleic acid coding therefor into a delivery vector is more advanced as there is less coding therefor in the delivery vector than for wild-type Cas9, and/or generating chimeric Cas9 enzymes.

Also provided are uses of the present sequences, vectors, enzymes or systems, in medicine. Also provided are uses of the same in gene or genome editing.

In an additional aspect of the invention, a Cas9 enzyme may comprise one or more mutations and may be used as a generic DNA binding protein with or without fusion to a functional domain. The mutations may be artificially introduced mutations or gain- or loss-of-function mutations. The mutations may include but are not limited to mutations in one of the catalytic domains (D10 and H840) in the RuvC and HNH catalytic domains, respectively. Further mutations have been characterized. In one aspect of the invention, the transcriptional activation domain may be VP64. In other aspects of the invention, the transcriptional repressor domain may be KRAB or SID4X. Other aspects of the invention relate to the mutated Cas9 enzyme being fused to domains which include but are not limited to a transcriptional activator, repressor, a recombinase, a transposase, a histone remodeler, a demethylase, a DNA methyltransferase, a cryptochrome, a light inducible/controllable domain or a chemically inducible/controllable domain.

In a further embodiment, the invention provides for methods to generate mutant tracrRNA and direct repeat sequences or mutant chimeric guide sequences that allow for enhancing performance of these RNAs in cells. Aspects of the invention also provide for selection of said sequences.

Aspects of the invention also provide for methods of simplifying the cloning and delivery of components of the CRISPR complex. In the preferred embodiment of the invention, a suitable promoter, such as the U6 promoter, is amplified with a DNA oligo and added onto the guide RNA. The resulting PCR product can then be transfected into cells to drive expression of the guide RNA. Aspects of the invention also relate to the guide RNA being transcribed in vitro or ordered from a synthesis company and directly transfected.

In one aspect, the invention provides for methods to improve activity by using a more active polymerase. In a preferred embodiment, the expression of guide RNAs under the control of the T7 promoter is driven by the expression of the T7 polymerase in the cell. In an advantageous embodiment, the cell is a eukaryotic cell. In a preferred embodiment the eukaryotic cell is a human cell. In a more preferred embodiment the human cell is a patient specific cell, e.g., a cell removed from a patient that may be modified and/or expanded into a cell population or a modified cell population, for instance, for re-administration to the patient.

In one aspect, the invention provides for methods of reducing the toxicity of Cas enzymes. In certain aspects, the Cas enzyme is any Cas9 as described herein, for instance any naturally-occurring bacterial Cas9 as well as any chimaeras, mutants, homologs or orthologs. In one aspect, the Cas enzyme is a nickase. In a preferred embodiment, the Cas9 is delivered into the cell in the form of mRNA. This allows for the transient expression of the enzyme thereby reducing toxicity. In another embodiment, the Cas9 is delivered into the cell in the nucleotide construct that encodes and expresses the Cas9 enzyme. In another preferred embodiment, the invention also provides for methods of expressing Cas9 under the control of an inducible promoter, and the constructs used therein.

In another aspect, the invention provides for methods of improving the in vivo applications of the CRISPR-Cas system. In the preferred embodiment, the Cas enzyme is wildtype Cas9 or any of the modified versions described herein, including any naturally-occurring bacterial Cas9 as well as any chimaeras, mutants, homologs or orthologs. In some methods of the invention the CRISPR enzyme comprises one or more mutations in one of the catalytic domains. In one aspect, the Cas enzyme is a nickase. An advantageous aspect of the invention provides for the selection of Cas9 homologs that are easily packaged into viral vectors for delivery. Cas9 orthologs typically share the general organization of 3-4 RuvC domains and a HNH domain. The 5' most RuvC domain cleaves the non-complementary strand, and the HNH domain cleaves the complementary strand. All notations are in reference to the guide sequence.

The catalytic residue in the 5' RuvC domain is identified through homology comparison of the Cas9 of interest with other Cas9 orthologs (from *S. pyogenes* type II CRISPR locus, *S. thermophilus* CRISPR locus 1, *S. thermophilus* CRISPR locus 3, and Franciscilla *novicida* type II CRISPR locus), and the conserved Asp residue (D10) is mutated to alanine to convert Cas9 into a complementary-strand nicking enzyme. Similarly, the conserved His and Asn residues in the HNH domains are mutated to Alanine to convert Cas9 into a non-complementary-strand nicking enzyme. In some embodiments, both sets of mutations may be made, to convert Cas9 into a non-cutting enzyme.

In some embodiments, the CRISPR enzyme is a type I or III CRISPR enzyme, preferably a type II CRISPR enzyme. This type II CRISPR enzyme may be any Cas enzyme. A preferred Cas enzyme may be identified as Cas9 as this can refer to the general class of enzymes that share homology to the biggest nuclease with multiple nuclease domains from the type II CRISPR system. Most preferably, the Cas9 enzyme is from, or is derived from, spCas9 or saCas9. By derived, Applicants mean that the derived enzyme is largely based, in the sense of having a high degree of sequence homology with, a wildtype enzyme, but that it has been mutated (modified) in some way as described herein It will be appreciated that the terms Cas and CRISPR enzyme are generally used herein interchangeably, unless otherwise apparent. As mentioned above, many of the residue numberings used herein refer to the Cas9 enzyme from the type II CRISPR locus in *Streptococcus pyogenes*. However, it will be appreciated that this invention includes many more Cas9s from other species of microbes, such as SpCas9, SaCas9, St1Cas9 and so forth. Further examples are provided herein. The skilled person will be able to determine appropriate corresponding residues in Cas9 enzymes other than SpCas9 by comparison of the relevant amino acid sequences. Thus, where a specific amino acid replacement is referred to using the SpCas9 numbering, then, unless the context makes it apparent this is not intended to refer to other Cas9 enzymes, the disclosure is intended to encompass corresponding modifications in other Cas9 enzymes.

An example of a codon optimized sequence, in this instance optimized for humans (i.e. being optimized for expression in humans) is provided herein, see the SaCas9 human codon optimized sequence. Whilst this is preferred, it will be appreciated that other examples are possible and codon optimization for a host species is known.

In further embodiments, the invention provides for methods of enhancing the function of Cas9 by generating chimeric Cas9 proteins. Chimeric Cas9 proteins chimeric Cas9s may be new Cas9 containing fragments from more than one naturally occurring Cas9. These methods may comprise fusing N-terminal fragments of one Cas9 homolog with C-terminal fragments of another Cas9 homolog. These methods also allow for the selection of new properties displayed by the chimeric Cas9 proteins.

It will be appreciated that in the present methods, where the organism is an animal or a plant, the modification may occur ex vivo or in vitro, for instance in a cell culture and in some instances not in vivo. In other embodiments, it may occur in vivo.

In one aspect, the invention provides a method of modifying an organism or a non-human organism by manipulation of a target sequence in a genomic locus of interest (e.g. an integrated viral sequence) comprising:

delivering a non-naturally occurring or engineered composition comprising:
A)—I. a CRISPR-Cas system chimeric RNA (chiRNA) polynucleotide sequence, wherein the polynucleotide sequence comprises:
(a) a guide sequence capable of hybridizing to a target sequence in a eukaryotic cell,
(b) a tracr mate sequence, and
(c) a tracr sequence, and
II. a polynucleotide sequence encoding a CRISPR enzyme comprising at least one or more nuclear localization sequences,
wherein (a), (b) and (c) are arranged in a 5' to 3' orientation,
wherein when transcribed, the tracr mate sequence hybridizes to the tracr sequence and the guide sequence directs sequence-specific binding of a CRISPR complex to the target sequence, and
wherein the CRISPR complex comprises the CRISPR enzyme complexed with (1) the guide sequence that is hybridized or hybridizable to the target sequence, and (2) the tracr mate sequence that is hybridized or hybridizable to the tracr sequence and the polynucleotide sequence encoding a CRISPR enzyme is DNA or RNA, or
(B) I. polynucleotides comprising:
(a) a guide sequence capable of hybridizing to a target sequence in a eukaryotic cell, and
(b) at least one or more tracr mate sequences,
II. a polynucleotide sequence encoding a CRISPR enzyme, and
III. a polynucleotide sequence comprising a tracr sequence,
wherein when transcribed, the tracr mate sequence hybridizes to the tracr sequence and the guide sequence directs sequence-specific binding of a CRISPR complex to the target sequence, and
wherein the CRISPR complex comprises the CRISPR enzyme complexed with (1) the guide sequence that is hybridized or hybridizable to the target sequence, and (2) the tracr mate sequence that is hybridized or hybridizable to the tracr sequence, and the polynucleotide sequence encoding a CRISPR enzyme is DNA or RNA.

Any or all of the polynucleotide sequence encoding a CRISPR enzyme, guide sequence, tracr mate sequence or tracr sequence, may be RNA. The polynucleotides encoding the sequence encoding a CRISPR enzyme, the guide sequence, tracr mate sequence or tracr sequence may be RNA and may be delivered via liposomes, nanoparticles, exosomes, microvesicles, or a gene-gun.

It will be appreciated that where reference is made to a polynucleotide, which is RNA and is said to 'comprise' a feature such a tracr mate sequence, the RNA sequence includes the feature. Where the polynucleotide is DNA and is said to comprise a feature such a tracr mate sequence, the DNA sequence is or can be transcribed into the RNA including the feature at issue. Where the feature is a protein, such as the CRISPR enzyme, the DNA or RNA sequence referred to is, or can be, translated (and in the case of DNA transcribed first).

Accordingly, in certain embodiments the invention provides a method of modifying an organism, e.g., mammal including human or a non-human mammal or organism by manipulation of a target sequence in a genomic locus of interest comprising delivering a non-naturally occurring or engineered composition comprising a viral or plasmid vector system comprising one or more viral or plasmid vectors operably encoding a composition for expression thereof, wherein the composition comprises: (A) a non-naturally occurring or engineered composition comprising a vector system comprising one or more vectors comprising I. a first regulatory element operably linked to a CRISPR-Cas system chimeric RNA (chiRNA) polynucleotide sequence, wherein the polynucleotide sequence comprises (a) a guide sequence capable of hybridizing to a target sequence in a eukaryotic cell, (b) a tracr mate sequence, and (c) a tracr sequence, and II. a second regulatory element operably linked to an enzyme-coding sequence encoding a CRISPR enzyme comprising at least one or more nuclear localization sequences (or optionally at least one or more nuclear localization sequences as some embodiments can involve no NLS), wherein (a), (b) and (c) are arranged in a 5' to 3' orientation, wherein components I and II are located on the same or different vectors of the system, wherein when transcribed, the tracr mate sequence hybridizes to the tracr sequence and the guide sequence directs sequence-specific binding of a CRISPR complex to the target sequence, and wherein the CRISPR complex comprises the CRISPR enzyme complexed with (1) the guide sequence that is hybridized or hybridizable to the target sequence, and (2) the tracr mate sequence that is hybridized or hybridizable to the tracr sequence, or (B) a non-naturally occurring or engineered composition comprising a vector system comprising one or more vectors comprising I. a first regulatory element operably linked to (a) a guide sequence capable of hybridizing to a target sequence in a eukaryotic cell, and (b) at least one or more tracr mate sequences, II. a second regulatory element operably linked to an enzyme-coding sequence encoding a CRISPR enzyme, and III. a third regulatory element operably linked to a tracr sequence, wherein components I, II and III are located on the same or different vectors of the system, wherein when transcribed, the tracr mate sequence hybridizes to the tracr sequence and the guide sequence directs sequence-specific binding of a CRISPR complex to the target sequence, and wherein the CRISPR complex comprises the CRISPR enzyme complexed with (1) the guide sequence that is hybridized or hybridizable to the target sequence, and (2) the tracr mate sequence that is hybridized or hybridizable to the tracr sequence. In some embodiments, components I, II and III are located on the same vector. In other embodiments, components I and II are located on the same vector, while component III is located on another vector. In other embodiments, components I and III are located on the same vector, while component II is located on another vector. In other embodiments, components II and III are located on the same vector, while component I is located on another vector. In other embodiments, each of components I, II and III is located on different vectors. The invention also provides a viral or plasmid vector system as described herein.

Preferably, the vector is a viral vector, such as a lenti- or baculo- or preferably adeno-viral/adeno-associated viral vectors, but other means of delivery are known (such as yeast systems, microvesicles, gene guns/means of attaching vectors to gold nanoparticles) and are provided. In some embodiments, one or more of the viral or plasmid vectors may be delivered via liposomes, nanoparticles, exosomes, microvesicles, or a gene-gun.

By manipulation of a target sequence, Applicants also mean the epigenetic manipulation of a target sequence. This may be of the chromatin state of a target sequence, such as by modification of the methylation state of the target sequence (i.e. addition or removal of methylation or methylation patterns or CpG islands), histone modification, increasing or reducing accessibility to the target sequence, or by promoting 3D folding. In relation to treatment of viral infections, however, excision of integrated viral genome sequences is the manipulation of primary interest.

It will be appreciated that where reference is made to a method of modifying an organism or mammal including human or a non-human mammal or organism by manipulation of a target sequence in a genomic locus of interest, this may apply to the organism (or mammal) as a whole or just a single cell or population of cells from that organism. In the case of humans, for instance, Applicants envisage, inter alia, a single cell or a population of cells and these may preferably be modified ex vivo and then re-introduced. In this case, a biopsy or other tissue or biological fluid sample may be necessary. Stem cells are also particularly preferred in this regard. But, of course, in vivo embodiments are also envisaged.

In certain embodiments the invention provides a method of treating or inhibiting a condition caused by the presence of an integrated viral sequence in a genomic locus of interest in a subject (e.g., mammal or human) or a non-human subject (e.g., mammal) in need thereof comprising modifying the subject or a non-human subject by manipulation of a target sequence in the integrated viral sequence and wherein the condition is susceptible to treatment or inhibition by manipulation of the target sequence comprising providing treatment comprising: delivering a non-naturally occurring or engineered composition comprising an AAV or lentivirus vector system comprising one or more AAV or lentivirus vectors operably encoding a composition for expression thereof, wherein the target sequence is manipulated by the composition when expressed, wherein the composition comprises: (A) a non-naturally occurring or engineered composition comprising a vector system comprising one or more vectors comprising I. a first regulatory element operably linked to a CRISPR-Cas system chimeric RNA (chiRNA) polynucleotide sequence, wherein the polynucleotide sequence comprises (a) a guide sequence capable of hybridizing to a target sequence in a eukaryotic cell, (b) a tracr mate sequence, and (c) a tracr sequence, and II. a second regulatory element operably linked to an enzyme-coding sequence encoding a CRISPR enzyme comprising at least one or more nuclear localization sequences (or optionally at least one or more nuclear localization sequences as some embodiments can involve no NLS, i.e., there can be zero NLSs but advantageously there is greater than zero NLSs, such as one or more or advantageously two or more NLSs, and thus the invention comprehends embodiments wherein there is 0, 1, 2, 3, or more NLSs) wherein (a), (b) and (c) are arranged in a 5' to 3' orientation, wherein components I and II are located on the same or different vectors of the system, wherein when transcribed, the tracr mate sequence hybridizes to the tracr sequence and the guide sequence directs sequence-specific binding of a CRISPR complex to the target sequence, and wherein the CRISPR complex comprises the CRISPR enzyme complexed with (1) the guide sequence that is hybridized or hybridizable to the target sequence, and (2) the tracr mate sequence that is hybridized or hybridizable to the tracr sequence, or (B) a non-naturally occurring or engineered composition comprising a vector system comprising one or more vectors comprising I. a first regulatory element operably linked to (a) a guide sequence capable of hybridizing to a target sequence in a eukaryotic cell, and (b) at least one or more tracr mate sequences, II. a second regulatory element operably linked to an enzyme-coding sequence encoding a CRISPR enzyme, and III. a third regulatory element operably linked to a tracr sequence, wherein components I, II and III are located on the same or different vectors of the system, wherein when transcribed, the tracr mate sequence hybridizes to the tracr sequence and the guide sequence directs sequence-specific binding of a CRISPR complex to the target sequence, and wherein the CRISPR complex comprises the CRISPR enzyme complexed with (1) the guide sequence that is hybridized or hybridizable to the target sequence, and (2) the tracr mate sequence that is hybridized or hybridizable to the tracr sequence. In some embodiments, components I, II and III are located on the same vector. In other embodiments, components I and II are located on the same vector, while component III is located on another vector. In other embodiments, components I and III are located on the same vector, while component II is located on another vector. In other embodiments, components II and III are located on the same vector, while component I is located on another vector. In other embodiments, each of components I, II and III is located on different vectors. The invention also provides a viral (e.g. AAV or lentivirus) vector system as described herein. Delivery therefore can be via a vector, such as a viral vector, e.g., a recombinant viral vector delivery system; and, this system can be an AAV or lentivirus or derived from an AAV or a lentivirus (e.g., a recombinant AAV or lentivirus that expresses that which is foreign, heterologous or that which is not homologous or native to the virus may make some consider the virus "derived from" is parent virus). In some methods of the invention the viral vector is a lentivirus-derived vector. In some methods of the invention the viral vector is an *Agrobacterium* Ti or Ri plasmid for use in plants.

The organism or subject is a eukaryote (including mammal including human) or a non-human eukaryote or a non-human animal or a non-human mammal. In some embodiments, the organism or subject is a non-human animal, and may be an arthropod, for example, an insect, or may be a nematode. In some methods of the invention the organism or subject is a plant. In some methods of the invention the organism or subject is a mammal or a non-human mammal. A non-human mammal may be for example a rodent (preferably a mouse or a rat), an ungulate, or a primate. In some methods of the invention the organism or subject is a plant or algae, including microalgae, or is a fungus. In some methods of the invention the viral vector is an AAV or a lentivirus, and can be part of a vector system as described herein. In some methods of the invention the CRISPR enzyme is a Cas9. In some methods of the invention the expression of the guide sequence is under the control of the T7 promoter and is driven by the expression of T7 polymerase. In some methods of the invention the expression of the guide sequence is under the control of a U6 promoter. In some methods of the invention the CRISPR enzyme comprises one or more mutations in one of the catalytic domains. In some methods of the invention the CRISPR enzyme is a Cas9 nickase.

The invention in some embodiments comprehends a method of delivering a CRISPR enzyme comprising delivering to a cell a nucleic acid molecule, e.g., DNA, RNA, mRNA encoding the CRISPR enzyme. In some of these methods the CRISPR enzyme is a Cas9. This allows for the transient expression of the enzyme thereby reducing toxicity. In another embodiment, the Cas9 is delivered into the cell in the nucleotide construct that encodes and expresses the Cas9 enzyme.

The invention also provides methods of preparing the vector systems of the invention, in particular the viral vector systems as described herein. The invention in some embodiments comprehends a method of preparing the AAV of the invention comprising transfecting plasmid(s) containing or consisting essentially of nucleic acid molecule(s) coding for the AAV into AAV-infected cells, and supplying AAV rep and/or cap obligatory for replication and packaging of the AAV. In some embodiments the AAV rep and/or cap obligatory for replication and packaging of the AAV are supplied by transfecting the cells with helper plasmid(s) or helper virus(es). In some embodiments the helper virus is a poxvirus, adenovirus, herpesvirus or baculovirus. In some embodiments the poxvirus is a vaccinia virus. In some embodiments the cells are mammalian cells. And in some embodiments the cells are insect cells and the helper virus is baculovirus. In other embodiments, the virus is a lentivirus.

In plants, viral pathogens are often host-specific, but this is not always the case. For instance, citrus tristeza virus infects only a few species in the Citrus genus, whereas cucumber mosaic virus infects over 1000 species in 85 plant families. Plants have existing and induced defenses to resist most pathogens, but the invention offers new ways to clear viral infections from plants.

The invention further comprehends a composition of the invention or a CRISPR enzyme thereof (including or alternatively mRNA encoding the CRISPR enzyme) for use in medicine or in therapy. In some embodiments the invention comprehends a composition according to the invention or a CRISPR enzyme thereof (including or alternatively a nucleic acid molecule, e.g., mRNA encoding the CRISPR enzyme) for use in a method according to the invention. In some embodiments the invention provides for the use of a composition of the invention or a CRISPR enzyme thereof (including or alternatively mRNA encoding the CRISPR enzyme) in ex vivo gene or genome editing. In certain embodiments the invention comprehends use of a composition of the invention or a CRISPR enzyme thereof (including or alternatively mRNA encoding the CRISPR enzyme) in the manufacture of a medicament for ex vivo gene or genome editing or for use in a method according of the invention. The invention thus also envisions a CRISPR-Cas Complex or a component thereof of any of any description herein for use in delivery to and/or a method of treating tissue, or tissue containing cells having a viral infection, such as Hepatitis B Virus; or in preparing or formulating a medicament or pharmaceutical composition for such treatment.

The invention comprehends in some embodiments a composition of the invention or a CRISPR enzyme thereof (including or alternatively mRNA encoding the CRISPR enzyme), wherein the target sequence is flanked at its 3' end by a 5' motif termed a proto-spacer adjacent motif or PAM, especially where the Cas9 is (or is derived from) S. pyogenes or S. aureus Cas9. For example, a suitable PAM is 5'-NRG or 5'-NNGRR (where N is any Nucleotide) for SpCas9 or SaCas9 enzymes (or derived enzymes), respectively, as mentioned below. For S. pyogenes Cas9 or derived enzymes, a suitable PAM is 5'-NRG.

It will be appreciated that SpCas9 or SaCas9 are those from or derived from S. pyogenes or S. aureus Cas9.

Apects of the invention comprehend improving the specificity of a CRISPR enzyme, e.g. Cas9, mediated gene targeting and reducing the likelihood of off-target modification by the CRISPR enzyme, e.g. Cas9. The invention in some embodiments comprehends a method of modifying an organism or a non-human organism by minimizing off-target modifications by manipulation of a first and a second target sequence on opposite strands of a DNA duplex in a genomic locus of interest in a cell comprising delivering a non-naturally occurring or engineered composition comprising:

I. a first CRISPR-Cas system chimeric RNA (chiRNA) polynucleotide sequence, wherein the first polynucleotide sequence comprises:
  (a) a first guide sequence capable of hybridizing to the first target sequence,
  (b) a first tracr mate sequence, and
  (c) a first tracr sequence,
II. a second CRISPR-Cas system chiRNA polynucleotide sequence, wherein the second polynucleotide sequence comprises:
  (a) a second guide sequence capable of hybridizing to the second target sequence,
  (b) a second tracr mate sequence, and
  (c) a second tracr sequence, and
III. a polynucleotide sequence encoding a CRISPR enzyme comprising at least one or more nuclear localization sequences and comprising one or more mutations, wherein (a), (b) and (c) are arranged in a 5' to 3' orientation, wherein when transcribed, the first and the second tracr mate sequence hybridize to the first and second tracr sequence respectively and the first and the second guide sequence directs sequence-specific binding of a first and a second CRISPR complex to the first and second target sequences respectively, wherein the first CRISPR complex comprises the CRISPR enzyme complexed with (1) the first guide sequence that is hybridized or hybridizable to the first target sequence, and (2) the first tracr mate sequence that is hybridized or hybridizable to the first tracr sequence, wherein the second CRISPR complex comprises the CRISPR enzyme complexed with (1) the second guide sequence that is hybridized or hybridizable to the second target sequence, and (2) the second tracr mate sequence that is hybridized or hybridizable to the second tracr sequence, wherein the polynucleotide sequence encoding a CRISPR enzyme is DNA or RNA, and wherein the first guide sequence directs cleavage of one strand of the DNA duplex near the first target sequence and the second guide sequence directs cleavage of the other strand near the second target sequence inducing a double strand break, thereby modifying the organism or the non-human organism by minimizing off-target modifications. In one aspect, the first nick and the second nick in the DNA is offset relative to each other by at least one base pair of the duplex. In one aspect, the first nick and the second nick are offset relative to each other so that the resulting DNA break has a 3' overhang. In one aspect, the first nick and the second nick are offset relative to each other so that the resulting DNA break has a 5' overhang. In one aspect, the first nick and the second nick are positioned relative to each other such that the overhang is at least 1 nucleotide (nt), at least 10 nt, at least 15 nt, at least 26 nt, at least 30 nt, at least 50 nt or more that at least 50 nt. Additional aspects of the invention comprising the resulting offset double nicked DNA strand can be appreciated by one skilled in the art, and exemplary uses of the double nick system are provided herein.

In some methods of the invention any or all of the polynucleotide sequence encoding the CRISPR enzyme, the first and the second guide sequence, the first and the second tracr mate sequence or the first and the second tracr sequence, is/are RNA. In further embodiments of the invention the polynucleotides encoding the sequence encoding the CRISPR enzyme, the first and the second guide sequence, the first and the second tracr mate sequence or the first and the second tracr sequence, is/are RNA and are delivered via liposomes, nanoparticles, exosomes, microvesicles, or a gene-gun. In certain embodiments of the invention, the first and second tracr mate sequence share 100% identity and/or the first and second tracr sequence share 100% identity. In some embodiments, the polynucleotides may be comprised within a vector system comprising one or more vectors. In preferred embodiments of the invention the CRISPR enzyme is a Cas9 enzyme, e.g. SpCas9. In an aspect of the invention the CRISPR enzyme comprises one or more mutations in a catalytic domain, wherein the one or more mutations are selected from the group consisting of D10A, E762A, H840A, N854A, N863A and D986A. In a highly preferred embodiment the CRISPR enzyme has the D10A mutation. In preferred embodiments, the first CRISPR enzyme has one or more mutations such that the enzyme is a complementary strand nicking enzyme, and the second CRISPR enzyme has one or more mutations such that the enzyme is a non-complementary strand nicking enzyme. Alternatively the first enzyme may be a non-complementary strand nicking enzyme, and the second enzyme may be a complementary strand nicking enzyme.

With respect to mutations of the CRISPR enzyme, when the enzyme is not SpCas9, mutations may be made at any or all residues corresponding to positions 10, 762, 840, 854, 863 and/or 986 of SpCas9 (which may be ascertained for instance by standard sequence comparison tools). In particular, any or all of the following mutations are preferred in SpCas9: D10A, E762A, H840A, N854A, N863A and/or D986A; as well as conservative substitution for any of the replacement amino acids is also envisaged. In an aspect the invention provides as to any or each or all embodiments herein-discussed wherein the CRISPR enzyme comprises at least one or more, or at least two or more mutations, wherein the at least one or more mutation or the at least two or more mutations is as to D10, E762, H840, N854, N863, or D986 according to SpCas9 protein, e.g., D10A, E762A, H840A, N854A, N863A and/or D986A as to SpCas9, or N580 according to SaCas9, e.g., N580A as to SaCas9, or any corresponding mutation(s) in a Cas9 of an ortholog to Sp or Sa, or the CRISPR enzyme comprises at least one mutation wherein at least H840 or N863A as to Sp Cas9 or N580A as to Sa Cas9 is mutated; e.g., wherein the CRISPR enzyme comprises H840A, or D10A and H840A, or D10A and N863A, according to SpCas9 protein, or any corresponding mutation(s) in a Cas9 of an ortholog to Sp protein or Sa protein.

In preferred methods of the invention the first guide sequence directing cleavage of one strand of the DNA duplex near the first target sequence and the second guide sequence directing cleavage of the other strand near the second target sequence results in a 5' overhang. In embodiments of the invention the 5' overhang is at most 200 base pairs, preferably at most 100 base pairs, or more preferably at most 50 base pairs. In embodiments of the invention the 5' overhang is at least 26 base pairs, preferably at least 30 base pairs or more preferably 34-50 base pairs.

The invention in some embodiments comprehends a method of modifying an organism or a non-human organism by minimizing off-target modifications by manipulation of a first and a second target sequence on opposite strands of a DNA duplex in a genomic locus of interest in a cell comprising delivering a non-naturally occurring or engineered composition comprising a vector system comprising one or more vectors comprising I. a first regulatory element operably linked to
  (a) a first guide sequence capable of hybridizing to the first target sequence, and
  (b) at least one or more tracr mate sequences,
II. a second regulatory element operably linked to
  (a) a second guide sequence capable of hybridizing to the second target sequence, and
  (b) at least one or more tracr mate sequences,
III. a third regulatory element operably linked to an enzyme-coding sequence encoding a CRISPR enzyme, and
IV. a fourth regulatory element operably linked to a tracr sequence,
  wherein components I, II, III and IV are located on the same or different vectors of the system, when transcribed, the tracr mate sequence hybridizes to the tracr sequence and the first and the second guide sequence direct sequence-specific binding of a first and a second CRISPR complex to the first and second target sequences respectively, wherein the first CRISPR complex comprises the CRISPR enzyme complexed with (1) the first guide sequence that is hybridized or hybridizable to the first target sequence, and (2) the tracr mate sequence that is hybridized or hybridizable to the tracr sequence, wherein the second CRISPR complex comprises the CRISPR enzyme complexed with (1) the second guide sequence that is hybridized or hybridizable to the second target sequence, and (2) the tracr mate sequence that is hybridized or hybridizable to the tracr sequence, wherein the polynucleotide sequence encoding a CRISPR enzyme is DNA or RNA, and wherein the first guide sequence directs cleavage of one strand of the DNA duplex near the first target sequence and the second guide sequence directs cleavage of the other strand near the second target sequence inducing a double strand break, thereby modifying the organism or the non-human organism by minimizing off-target modifications.

The invention also provides a vector system as described herein. The system may comprise one, two, three or four different vectors. Components I, II, III and IV may thus be located on one, two, three or four different vectors, and all combinations for possible locations of the components are herein envisaged, for example: components I, II, III and IV can be located on the same vector; components I, II, III and IV can each be located on different vectors; components I, II, II I and IV may be located on a total of two or three different vectors, with all combinations of locations envisaged, etc.

In some methods of the invention any or all of the polynucleotide sequence encoding the CRISPR enzyme, the first and the second guide sequence, the first and the second tracr mate sequence or the first and the second tracr sequence, is/are RNA. In further embodiments of the invention the first and second tracr mate sequence share 100% identity and/or the first and second tracr sequence share 100% identity. In preferred embodiments of the invention the CRISPR enzyme is a Cas9 enzyme, e.g. SpCas9. In an aspect of the invention the CRISPR enzyme comprises one or more mutations in a catalytic domain, wherein the one or more mutations are selected from the group consisting of D10A, E762A, H840A, N854A, N863A and D986A. In a highly preferred embodiment the CRISPR enzyme has the D10A mutation. In preferred embodiments, the first CRISPR enzyme has one or more mutations such that the enzyme is a complementary strand nicking enzyme, and the second CRISPR enzyme has one or more mutations such that the enzyme is a non-complementary strand nicking enzyme. Alternatively the first enzyme may be a non-complementary strand nicking enzyme, and the second enzyme may be a complementary strand nicking enzyme. In a further embodiment of the invention, one or more of the viral vectors are delivered via liposomes, nanoparticles, exosomes, microvesicles, or a gene-gun.

In preferred methods of the invention the first guide sequence directing cleavage of one strand of the DNA duplex near the first target sequence and the second guide sequence directing cleavage of other strand near the second target sequence results in a 5' overhang. In embodiments of the invention the 5' overhang is at most 200 base pairs, preferably at most 100 base pairs, or more preferably at most 50 base pairs. In embodiments of the invention the 5' overhang is at least 26 base pairs, preferably at least 30 base pairs or more preferably 34-50 base pairs.

The invention in some embodiments comprehends a method of modifying a genomic locus of interest by minimizing off-target modifications by introducing into a cell containing and expressing a double stranded DNA molecule encoding a gene product of interest an engineered, non-naturally occurring CRISPR-Cas system comprising a Cas protein having one or more mutations and two guide RNAs that target a first strand and a second strand of the DNA molecule respectively, whereby the guide RNAs target the DNA molecule encoding the gene product and the Cas protein nicks each of the first strand and the second strand of the DNA molecule encoding the gene product, whereby expression of the gene product is altered; and, wherein the Cas protein and the two guide RNAs do not naturally occur together.

In preferred methods of the invention the Cas protein nicking each of the first strand and the second strand of the DNA molecule encoding the gene product results in a 5' overhang. In embodiments of the invention the 5' overhang is at most 200 base pairs, preferably at most 100 base pairs, or more preferably at most 50 base pairs. In embodiments of the invention the 5' overhang is at least 26 base pairs, preferably at least 30 base pairs or more preferably 34-50 base pairs.

Embodiments of the invention also comprehend the guide RNAs comprising a guide sequence fused to a tracr mate sequence and a tracr sequence. In an aspect of the invention the Cas protein is codon optimized for expression in a eukaryotic cell, preferably a mammalian cell or a human cell. As explained in more detail below, codon usage can even be optimized for expression in particular cell types e.g. for liver cells. In further embodiments of the invention the Cas protein is a type II CRISPR-Cas protein, e.g. a Cas9 protein. In a highly preferred embodiment the Cas protein is a Cas9 protein, e.g. SpCas9. In aspects of the invention the Cas protein has one or more mutations selected from the group consisting of D10A, E762A, H840A, N854A, N863A and D986A. In a highly preferred embodiment the Cas protein has the D10A mutation.

Aspects of the invention relate to the expression of the gene product being decreased or a template polynucleotide being further introduced into the DNA molecule encoding the gene product or an intervening sequence being excised precisely by allowing the two 5' overhangs to reanneal and ligate or the activity or function of the gene product being altered or the expression of the gene product being increased. In an embodiment of the invention, the gene product is a protein.

The invention also comprehends an engineered, non-naturally occurring CRISPR-Cas system comprising a Cas protein having one or more mutations and two guide RNAs that target a first strand and a second strand respectively of a double stranded DNA molecule encoding a gene product in a cell, whereby the guide RNAs target the DNA molecule encoding the gene product and the Cas protein nicks each of the first strand and the second strand of the DNA molecule encoding the gene product, whereby expression of the gene product is altered; and, wherein the Cas protein and the two guide RNAs do not naturally occur together.

In aspects of the invention the guide RNAs may comprise a guide sequence fused to a tracr mate sequence and a tracr sequence. In an embodiment of the invention the Cas protein is a type II CRISPR-Cas protein. In an aspect of the invention the Cas protein is codon optimized for expression in a eukaryotic cell, preferably a mammalian cell or a human cell. In further embodiments of the invention the Cas protein is a type II CRISPR-Cas protein, e.g. a Cas9 protein. In a highly preferred embodiment the Cas protein is a Cas9 protein, e.g. SpCas9. In aspects of the invention the Cas protein has one or more mutations selected from the group consisting of D10A, E762A, H840A, N854A, N863A and D986A. In a highly preferred embodiment the Cas protein has the D10A mutation.

Aspects of the invention relate to the expression of the gene product being decreased or a template polynucleotide being further introduced into the DNA molecule encoding the gene product or an intervening sequence being excised precisely by allowing the two 5' overhangs to reanneal and ligate or the activity or function of the gene product being altered or the expression of the gene product being increased. In an embodiment of the invention, the gene product is a protein.

The invention also comprehends an engineered, non-naturally occurring vector system comprising one or more vectors comprising:
  a) a first regulatory element operably linked to each of two CRISPR-Cas system guide RNAs that target a first strand and a second strand respectively of a double stranded DNA molecule encoding a gene product,
  b) a second regulatory element operably linked to a Cas protein,
wherein components (a) and (b) are located on same or different vectors of the system, whereby the guide RNAs target the DNA molecule encoding the gene product and the Cas protein nicks each of the first strand and the second strand of the DNA molecule encoding the gene product, whereby expression of the gene product is altered; and, wherein the Cas protein and the two guide RNAs do not naturally occur together.

In aspects of the invention the guide RNAs may comprise a guide sequence fused to a tracr mate sequence and a tracr sequence. In an embodiment of the invention the Cas protein is a type II CRISPR-Cas protein. In an aspect of the invention the Cas protein is codon optimized for expression in a eukaryotic cell, preferably a mammalian cell or a human cell. In further embodiments of the invention the Cas protein is a type II CRISPR-Cas protein, e.g. a Cas9 protein. In a highly preferred embodiment the Cas protein is a Cas9 protein, e.g. SpCas9. In aspects of the invention the Cas protein has one or more mutations selected from the group consisting of D10A, E762A, H840A, N854A, N863A and D986A. In a highly preferred embodiment the Cas protein has the D10A mutation.

Aspects of the invention relate to the expression of the gene product being decreased or a template polynucleotide being further introduced into the DNA molecule encoding the gene product or an intervening sequence being excised precisely by allowing the two 5' overhangs to reanneal and ligate or the activity or function of the gene product being altered or the expression of the gene product being increased. In an embodiment of the invention, the gene product is a protein. In preferred embodiments of the invention the vectors of the system are viral vectors. In a further embodiment, the vectors of the system are delivered via liposomes, nanoparticles, exosomes, microvesicles, or a gene-gun.

In one aspect, the invention provides a method of modifying a target polynucleotide in a eukaryotic cell. In some embodiments, the method comprises allowing a CRISPR complex to bind to the target polynucleotide to effect cleavage of said target polynucleotide thereby modifying the target polynucleotide, wherein the CRISPR complex comprises a CRISPR enzyme complexed with a guide sequence hybridized or hybridizable to a target sequence within said target polynucleotide, wherein said guide sequence is linked to a tracr mate sequence which in turn hybridizes to a tracr sequence. In some embodiments, said cleavage comprises cleaving one or two strands at the location of the target sequence by said CRISPR enzyme. In some embodiments, said cleavage results in decreased transcription of a target gene. In some embodiments, the method further comprises repairing said cleaved target polynucleotide by homologous recombination with an exogenous template polynucleotide, wherein said repair results in a mutation comprising an insertion, deletion, or substitution of one or more nucleotides of said target polynucleotide. In some embodiments, said mutation results in one or more amino acid changes in a protein expressed from a gene comprising the target sequence. In some embodiments, the method further comprises delivering one or more vectors to said eukaryotic cell, wherein the one or more vectors drive expression of one or more of: the CRISPR enzyme, the guide sequence linked to the tracr mate sequence, and the tracr sequence. In some embodiments, said vectors are delivered to the eukaryotic cell in a subject. In some embodiments, said modifying takes place in said eukaryotic cell in a cell culture. In some embodiments, the method further comprises isolating said eukaryotic cell from a subject prior to said modifying. In some embodiments, the method further comprises returning said eukaryotic cell and/or cells derived therefrom to said subject.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR enzyme complexed with a guide sequence hybridized or hybridizable to a target sequence within said polynucleotide, wherein said guide sequence is linked to a tracr mate sequence which in turn hybridizes to a tracr sequence. In some embodiments, the method further comprises delivering one or more vectors to said eukaryotic cells, wherein the one or more vectors drive expression of one or more of: the CRISPR enzyme, the guide sequence linked to the tracr mate sequence, and the tracr sequence.

In one aspect, the invention provides for methods of modifying a target polynucleotide in a eukaryotic cell. In some embodiments, the method comprises allowing a CRISPR complex to bind to the target polynucleotide to effect cleavage of said target polynucleotide thereby modifying the target polynucleotide, wherein the CRISPR complex comprises a CRISPR enzyme complexed with a guide sequence hybridized or hybridizable to a target sequence within said target polynucleotide, wherein said guide sequence is linked to a tracr mate sequence which in turn hybridizes to a tracr sequence.

In other embodiments, this invention provides a method of modifying expression of a polynucleotide in a eukaryotic cell. The method comprises decreasing expression of a target polynucleotide by using a CRISPR complex that binds to the polynucleotide.

Where desired, to effect the modification of the expression in a cell, one or more vectors comprising a tracr sequence, a guide sequence linked to the tracr mate sequence, a sequence encoding a CRISPR enzyme is delivered to a cell. In some methods, the one or more vectors comprises a regulatory element operably linked to an enzyme-coding sequence encoding said CRISPR enzyme comprising a nuclear localization sequence; and a regulatory element operably linked to a tracr mate sequence and one or more insertion sites for inserting a guide sequence upstream of the tracr mate sequence. When expressed, the guide sequence directs sequence-specific binding of a CRISPR complex to a target sequence in a cell. Typically, the CRISPR complex comprises a CRISPR enzyme complexed with (1) the guide sequence that is hybridized or hybridizable to the target sequence, and (2) the tracr mate sequence that is hybridized or hybridizable to the tracr sequence.

In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein or microRNA is not produced.

In certain embodiments, the CRISPR enzyme comprises one or more mutations selected from the group consisting of D10A, E762A, H840A, N854A, N863A or D986A and/or the one or more mutations is in a RuvC1 or HNH domain of the CRISPR enzyme or is a mutation as otherwise as discussed herein. In some embodiments, the CRISPR enzyme has one or more mutations in a catalytic domain, wherein when transcribed, the tracr mate sequence hybridizes to the tracr sequence and the guide sequence directs sequence-specific binding of a CRISPR complex to the target sequence, and wherein the enzyme further comprises a functional domain. In some embodiments, the functional domain is a transcriptional activation domain, preferably VP64. In some embodiments, the functional domain is a transcription repression domain, preferably KRAB. In some embodiments, the transcription repression domain is SID, or concatemers of SID (eg SID4X). In some embodiments, the functional domain is an epigenetic modifying domain, such that an epigenetic modifying enzyme is provided. In some embodiments, the functional domain is an activation domain, which may be the P65 activation domain. Thus, in some embodiments a mutated Cas9 enzyme may be fused to a protein domain or functional domain.

In some embodiments, the CRISPR enzyme is a type I or III CRISPR enzyme, but is preferably a type II CRISPR enzyme. This type II CRISPR enzyme may be any Cas enzyme. A Cas enzyme may be identified as Cas9 as this can refer to the general class of enzymes that share homology to the biggest nuclease with multiple nuclease domains from the type II CRISPR system. Most preferably, the Cas9 enzyme is from, or is derived from, spCas9 or saCas9. By derived, Applicants mean that the derived enzyme is largely based, in the sense of having a high degree of sequence homology with, a wildtype enzyme, but that it has been mutated (modified) in some way as described herein.

It will be appreciated that the terms Cas and CRISPR enzyme are generally used herein interchangeably, unless otherwise apparent. As mentioned above, many of the residue numberings used herein refer to the Cas9 enzyme from the type II CRISPR locus in *Streptococcus pyogenes*. However, it will be appreciated that this invention includes many more Cas9s from other species of microbes, such as SpCas9, SaCa9, St1Cas9 and so forth.

An example of a codon optimized sequence, in this instance optimized for humans (i.e. being optimized for expression in humans) is provided herein, see the SaCas9 human codon optimized sequence. Whilst this is preferred, it will be appreciated that other examples are possible and codon optimization for a host species is known.

Preferably, delivery is in the form of a vector which may be a viral vector, such as a lenti- or baculo- or preferably adeno-viral/adeno-associated viral vectors, but other means of delivery are known (such as yeast systems, microvesicles, gene guns/means of attaching vectors to gold nanoparticles) and are provided. A vector may mean not only a viral or yeast system (for instance, where the nucleic acids of interest may be operably linked to and under the control of (in terms of expression, such as to ultimately provide a processed RNA) a promoter), but also direct delivery of nucleic acids into a host cell. While in herein methods the vector may be a viral vector and this is advantageously an AAV, other viral vectors as herein discussed can be employed, such as lentivirus. For example, baculoviruses may be used for expression in insect cells. These insect cells may, in turn be useful for producing large quantities of further vectors, such as AAV or lentivirus vectors adapted for delivery of the present invention. Also envisaged is a method of delivering the present CRISPR enzyme comprising delivering to a cell mRNA encoding the CRISPR enzyme. It will be appreciated that in certain embodiments the CRISPR enzyme is truncated, and/or comprised of less than one thousand amino acids or less than four thousand amino acids, and/or is a nuclease or nickase, and/or is codon-optimized, and/or comprises one or more mutations, and/or comprises a chimeric CRISPR enzyme, and/or the other options as herein discussed. AAV and lentiviral vectors are preferred.

In certain embodiments, the target sequence is flanked or followed, at its 3' end, by a PAM suitable for the CRISPR enzyme, typically a Cas and in particular a Cas9.

For example, a suitable PAM is 5'-NRG or 5'-NNGRR for SpCas9 or SaCas9 enzymes (or derived enzymes), respectively.

The invention also relates to a method of modifying a cell of a eukaryotic organism by manipulating at least one target viral nucleic acid within the cell, the method comprising introducing into the cell an exogenous composition capable of forming a Clustered Regularly Interspersed Short Palindromic Repeats (CRISPR)-CRISPR-associated (Cas) (CRISPR-Cas) complex, the composition comprising:

(A) CRISPR-Cas system polynucleotide sequences comprising:
  (i) a guide sequence, which when transcribed is capable of hybridizing to a sequence of the at least one target viral nucleic acid to be manipulated;
  (ii) a trans-activating CRISPR RNA (tracr) mate sequence, which is linked to the guide sequence; and
  (iii) a tracr sequence, wherein when transcribed all or a portion of the tracr sequence is capable of hybridizing to the tracr mate sequence; and
(B) a CRISPR/Cas enzyme or a polynucleotide encoding a CRISPR/Cas enzyme, wherein when the CRISPR/Cas system polynucleotide sequences are present as RNA within the cell and the CRISPR/Cas enzyme is present as a protein within the cell:
  (i) the tracr mate sequence is hybridized to the tracr sequence or portion thereof;
  (ii) the CRISPR/Cas system polynucleotide sequences are associated with the CRISPR/Cas enzyme, so forming a CRISPR/Cas complex; and
  (iii) the guide sequence hybridizes to a sequence of the at least one target viral nucleic acid thereby directing sequence-specific binding of the CRISPR/Cas complex to the at least one sequence of the target viral nucleic acid, whereupon said sequence of said target viral nucleic acid is manipulated by the CRISPR/Cas enzyme of the complex.

The invention also relates to an exogenous composition which, when introduced into a cell of a eukaryotic organism, is capable of forming at least one Clustered Regularly Interspersed Short Palindromic Repeats (CRISPR)-CRISPR-associated (Cas) (CRISPR-Cas) complex, wherein the complex is capable of modifying the cell by manipulating of at least one target viral nucleic acid within the cell, the composition comprising:

(A) Clustered Regularly Interspersed Short Palindromic Repeats (CRISPR)-CRISPR associated (Cas) (CRISPR-Cas) system polynucleotide sequences comprising:
  (i) a guide sequence, which when transcribed is capable of hybridizing to a sequence of the at least one target viral nucleic acid to be manipulated;
  (ii) a trans-activating CRISPR RNA (tracr) mate sequence, which is linked to the guide sequence; and
  (iii) a tracr sequence, wherein when transcribed all or a portion of the tracr sequence is capable of hybridizing with the tracr mate sequence; and
(B) a CRISPR/Cas enzyme or a polynucleotide encoding a CRISPR/Cas enzyme, wherein when the CRISPR/Cas system polynucleotide sequences are present as RNA within the cell and the CRISPR/Cas enzyme is present as a protein within the cell:
  (i) the tracr mate sequence is hybridized to the tracr sequence or portion thereof;
  (ii) the CRISPR/Cas system polynucleotide sequences are associated with the CRISPR/Cas enzyme, so forming a CRISPR/Cas complex; and
  (iii) the guide sequence hybridizes to a sequence of the at least one target viral nucleic acid thereby directing sequence-specific binding of the CRISPR/Cas complex to the at least one sequence of the target viral nucleic acid, whereupon said sequence of said target viral nucleic acid is manipulated by the CRISPR/Cas enzyme of the complex.

The invention also relates to a Clustered Regularly Interspersed Short Palindromic Repeats (CRISPR)-CRISPR-associated (Cas) (CRISPR-Cas) complex which, when introduced into a cell of a eukaryotic organism, is capable of modifying the cell by manipulating a target viral nucleic acid within the cell, the complex comprising:
  (A) CRISPR-Cas system RNA polynucleotide sequences comprising:
    (i) a guide sequence, which is capable of hybridizing to a sequence of the target viral nucleic acid to be manipulated;
    (ii) a trans-activating CRISPR RNA (tracr) mate sequence, which is linked to the guide sequence; and
    (iii) a tracr sequence, wherein all or a portion of the tracr sequence is capable of hybridizing with the tracr mate sequence; and
  (B) a CRISPR/Cas enzyme,
wherein when the CRISPR/Cas system RNA polynucleotide sequences and the CRISPR/Cas enzyme are present within the cell:
  (i) the tracr mate sequence is hybridized to the tracr sequence or portion thereof;
  (ii) the CRISPR/Cas system polynucleotide sequences are associated with the CRISPR/Cas enzyme, so forming a CRISPR/Cas complex; and
  (iii) the guide sequence hybridizes to a sequence of the target viral nucleic acid thereby directing sequence-specific binding of the CRISPR/Cas complex to the sequence of the target viral nucleic acid, whereupon said sequence of said target viral nucleic acid is manipulated by the CRISPR/Cas enzyme of the complex.

The invention also relates to a Clustered Regularly Interspersed Short Palindromic Repeats (CRISPR)-CRISPR-associated (Cas) (CRISPR-Cas) system chimeric RNA polynucleotide molecule (chiRNA) which, when introduced into a cell of a eukaryotic organism, is capable of associating with a CRISPR/Cas enzyme so forming a CRISPR-Cas complex, wherein the CRISPR-Cas complex is capable of modifying the cell by manipulating a target viral nucleic acid within the cell; the chiRNA comprising:
  (i) a guide sequence, which is capable of hybridizing to a sequence of the target viral nucleic acid to be manipulated;
  (ii) a trans-activating CRISPR RNA (tracr) mate sequence, which is linked to the guide sequence; and
  (iii) a tracr sequence, wherein all or a portion of the tracr sequence is capable of hybridizing with the tracr mate sequence; and
wherein when the chiRNA and the CRISPR/Cas enzyme are present within the cell:
  a) the tracr mate sequence hybridizes to the tracr sequence or portion thereof;
  b) the chiRNA associates with the CRISPR/Cas enzyme, so forming the CRISPR/Cas complex; and
  c) the guide sequence hybridizes to a sequence of the target viral nucleic acid thereby directing sequence-specific binding of the CRISPR/Cas complex to the sequence of the target viral nucleic acid whereupon said sequence of said target viral nucleic acid is manipulated by the CRISPR/Cas enzyme of the complex.

The invention also relates to a DNA polynucleotide molecule comprising sequences encoding a Clustered Regularly Interspersed Short Palindromic Repeats (CRISPR)-CRISPR-associated (Cas) (CRISPR-Cas) system chimeric RNA polynucleotide molecule (chiRNA), wherein upon introduction of said chiRNA into a cell of a eukaryotic organism said chiRNA is capable of associating with a CRISPR/Cas enzyme so forming a CRISPR-Cas complex, wherein the CRISPR-Cas complex is capable of modifying the cell by manipulating a target viral nucleic acid within the cell; the chiRNA comprising:
  (i) a guide sequence, which is capable of hybridizing to a sequence of the target viral nucleic acid to be manipulated;
  (ii) a trans-activating CRISPR RNA (tracr) mate sequence, which is linked to the guide sequence; and
  (iii) a tracr sequence, wherein all or a portion of the tracr sequence is capable of hybridizing with the tracr mate sequence; and
wherein when the chiRNA and the CRISPR/Cas enzyme are present within the cell:
  a) the tracr mate sequence hybridizes to the tracr sequence or portion thereof;
  b) the chiRNA associates with the CRISPR/Cas enzyme, so forming the CRISPR/Cas complex; and
  c) the guide sequence hybridizes to a sequence of the target viral nucleic acid thereby directing sequence-specific binding of the CRISPR/Cas complex to the sequence of the target viral nucleic acid whereupon said sequence of said target viral nucleic acid is manipulated by the CRISPR/Cas enzyme of the complex.

In embodiments described herein the guide sequence as described herein, which is capable of hybridizing to a sequence of a target nucleic acid to be manipulated, and the tracr mate sequence, as described herein, may preferably be linked in a tandem arrangement, wherein the tracr mate sequence comprises a region of sense sequence. The tracr sequence, as described herein, may comprise a region of antisense sequence which is capable of hybridizing with the region of sense sequence of the tracr mate sequence.

Preferably, when the tracr mate sequence (linked to the guide sequence) and the tracr sequence are present within the cell, the region of antisense sequence is hybridized to the region of sense sequence thereby forming a dual RNA molecule; and wherein when said dual RNA molecule binds within the cell to the CRISPR/Cas enzyme so forming a CRISPR-Cas complex, the guide sequence hybridizes to a sequence of the target nucleic acid thereby directing sequence-specific binding of the CRISPR/Cas complex to the target nucleic acid, whereupon manipulation of said sequence of said target nucleic acid is effected by the CRISPR/Cas enzyme of the complex.

As described herein certain embodiments may optionally comprise a chimeric single guide RNA molecule (sgRNA). Such sgRNA molecules may preferably comprise, in a tandem arrangement:
  I. a guide sequence, as described herein, which is capable of hybridizing to a sequence of the target nucleic acid to be manipulated;
  II. a tracr mate sequence, as described herein, comprising a region of sense sequence;
  III. a linker sequence; and
  IV. a tracr sequence, as described herein, comprising a region of antisense sequence which is positioned adjacent the linker sequence and which is capable of hybridizing with the region of sense sequence thereby forming a stem-loop.

In such cases the linker may be a polynucleotide linker, optionally comprising GAAA. Other linkers, such as those described herein, are envisaged. Preferably, in any such cases when the sgRNA molecule is present within the cell, the region of antisense sequence is hybridized to the region of sense sequence thereby forming the stem-loop; and wherein when said sgRNA molecule binds within the cell to the CRISPR/Cas enzyme so forming a CRISPR-Cas complex, the guide sequence hybridizes to a sequence of the target nucleic acid thereby directing sequence-specific binding of the CRISPR/Cas complex to the target nucleic acid, whereupon manipulation of said sequence of said target nucleic acid is effected by the CRISPR/Cas enzyme of the complex.

In the embodiments described herein the guide sequence, the trans-activating CRISPR RNA (tracr) mate sequence and the tracr sequence may be non-coding sequences. When transcribed, the tracr mate sequence may not be capable of hybridizing to a sequence of the at least one target viral nucleic acid to be manipulated, in contrast to the guide sequence.

As described herein, various manipulations of target viral nucleic acids may be performed by the CRISPR/Cas complexes described herein. Preferred manipulations of target viral nucleic acids include cleavage of viral DNA, as described in more detail herein.

In certain methods, compositions, complexes, chiRNAs or DNA polynucleotide molecules described herein, manipulation of at least one target viral nucleic acid within the cell is performed. However, as will be apparent, multiplexing methods are described and exemplified wherein multiple target viral nucleic acid sequences are manipulated by CRISPR/Cas complexes targeting different sequences of the target viral nucleic acid.

In the methods, compositions, complexes, chiRNAs or DNA polynucleotides described herein an "exogenous composition" is an engineered or non-naturally occurring composition.

As noted herein, the target sequence may be flanked or followed, at its 3' end, by a protospacer adjacent motif (PAM) suitable for recognition by the CRISPR enzyme of the complex, typically a Cas enzyme and more typically a Cas9 enzyme. For example, a suitable PAM is 5'-NRG or 5'-NNGRR for SpCas9 or SaCas9 enzymes (or derived enzymes), respectively. Other PAMs, such as are described herein, may be recognized in association with the target sequence depending upon the specific CRISPR enzyme used.

The CRISPR/Cas enzyme of the exogenous composition may be provided as a polynucleotide sequence which comprises either (a) RNA or (b) DNA wherein the polynucleotide sequence is operably linked to a regulatory element capable of directing expression of RNA encoding the CRISPR/Cas enzyme.

Any of the CRISPR/Cas system polynucleotide sequences of the exogenous composition may comprise either (a) RNA or (b) DNA wherein the polynucleotide sequences are operably linked to one or more regulatory elements capable of directing expression of CRISPR/Cas system RNA polynucleotide sequences.

Each of the CRISPR/Cas system polynucleotide sequences of the exogenous composition may consist of RNA and wherein the CRISPR/Cas system polynucleotide sequences may comprise a chimeric RNA polynucleotide molecule comprising the guide sequence, the tracr mate sequence and the tracr sequence.

Each of the CRISPR/Cas system polynucleotide sequences of the exogenous composition may be provided as DNA polynucleotide sequences further comprising at least one regulatory element operably linked to polynucleotide sequences encoding CRISPR/Cas system RNA polynucleotide sequences and capable of directing expression thereof, and wherein the CRISPR/Cas system RNA polynucleotide sequences may comprise a chimeric RNA polynucleotide (chiRNA) molecule comprising the guide sequence, the tracr mate sequence and the tracr sequence.

In the above-described methods, compositions, complexes, chiRNA or DNA polynucleotide molecules each of the guide sequence, the tracr mate sequences and the tracr sequence may be arranged in a 5' to 3' orientation; or each of the guide sequence, the tracr mate sequences and the tracr sequence may be arranged in a 3' to 5' orientation.

In the methods or compositions described herein (a) the CRISPR/Cas system polynucleotide sequences or polynucleotide sequences encoding the CRISPR/Cas system polynucleotide sequences and/or (b) polynucleotide sequences encoding the CRISPR/Cas enzyme may be comprised in one or more recombinant viral vectors. The polynucleotide sequences of (a) may be located on the same or different recombinant viral vector as polynucleotide sequences of (b).

The chiRNAs or the DNA polynucleotide molecules described herein may be comprised in a recombinant viral vector.

In the methods, compositions, complexes, chiRNAs or DNA polynucleotides described herein which utilize viral vectors, the viral vector may be a retroviral vector, optionally a lentiviral vector, a baculoviral vector, a herpes simplex virus vector, an adenoviral vector, an adenoassociated viral (AAV) vector such as AAV8 vector, or a poxvirus such as a vaccinia virus.

In the methods described herein (a) the CRISPR/Cas system polynucleotide sequences or polynucleotide sequences encoding the CRISPR/Cas system polynucleotide sequences and/or (b) polynucleotide sequences encoding the CRISPR/Cas enzyme may be delivered to the cell of the organism via liposomes, nanoparticles, exosomes, microvesicles or a gene-gun.

In the methods, compositions, complexes, chiRNAs or DNA polynucleotide molecules described herein the tracr sequence may be 30 or more nucleotides in length, 40 or more nucleotides in length, or 50 or more nucleotides in length.

In the methods, compositions, complexes, chiRNAs or DNA polynucleotide molecules described herein hybridization between the tracr sequence and the tracr mate sequence may produce a transcript having secondary structure, preferably a hairpin. The tracr sequence may comprise one or more regions capable of forming secondary structure, preferably a hairpin. The tracr sequence may comprise one or more hairpins, two or more hairpins, three or more hairpins, four or more hairpins, five or more hairpins, or at most five hairpins.

In some embodiments it may be preferred in a CRISPR complex that the tracr sequence has one or more hairpins and is 30 or more nucleotides in length, 40 or more nucleotides in length, or 50 or more nucleotides in length; the guide sequence is between 10 to 30 nucleotides in length, the CRISPR/Cas enzyme is a Type II Cas9 enzyme.

As described herein, preferred CRISPR/Cas enzymes are Type II CRISPR/Cas enzymes, preferably Type II Cas9 CRISPR/Cas enzymes or biologically active fragments or derivatives thereof.

In the methods, compositions, complexes, chiRNAs or DNA polynucleotide molecules described herein, the guide sequence may be 10 to 30 nucleotides in length.

In any of the methods, compositions, complexes, chiRNAs or DNA polynucleotide molecules described herein the CRISPR/Cas enzyme may be a Cas9 enzyme of *Streptococcus pyogenes* or a Cas9 enzyme of *Streptococcus aureus*, or a biologically active fragment or derivative thereof.

Described herein are specific NLS sequences which may be applied to the CRISPR/Cas enzymes.

In any of the methods, compositions, complexes, chiRNAs or DNA polynucleotide molecules described herein the CRISPR/Cas enzyme may further comprise one or more nuclear localization sequences (NLSs) capable of driving the accumulation of the CRISPR/Cas enzyme to a detectable amount in the nucleus of the cell of the organism. The CRISPR/Cas enzyme may comprise two or more NLSs, three or more NLSs, four or more NLSs, five or more NLSs, six or more NLSs, seven or more NLSs, eight or more NLSs, nine or more NLSs, or ten or more NLSs. The CRISPR/Cas enzyme may comprise at least one NLS at or near the amino-terminus of the CRISPR/Cas enzyme and/or at least one NLS at or near the carboxy-terminus the CRISPR/Cas enzyme.

In any of the methods, compositions, complexes, chiRNAs or DNA polynucleotide molecules described herein when present as RNA within the cell the guide sequence may be capable of hybridizing to a sequence of a target viral nucleic acid which is an episomal nucleic acid molecule which is not integrated into the genome of the organism and wherein said manipulation is a manipulation of the episomal viral nucleic acid molecule, preferably wherein the episomal nucleic acid molecule is a double-stranded DNA polynucleotide molecule. The double-stranded DNA polynucleotide may be an episomal viral nucleic acid which is a covalently closed circular DNA (cccDNA). Where the target viral nucleic acid is a hepatitis B virus (HBV) nucleic acid, the double-stranded DNA polynucleotide may preferably be an episomal viral nucleic acid which is a cccDNA.

In any of the methods, compositions, complexes, chiRNAs or DNA polynucleotide molecules described herein the CRISPR/Cas complex may be capable of reducing the amount of episomal viral nucleic acid molecule in a cell of the organism compared to the amount of episomal viral nucleic acid molecule in a cell of the organism in the absence of providing the complex.

In any of the methods, compositions, complexes, chiRNAs or DNA polynucleotide molecules described herein the CRISPR/Cas complex may be capable of manipulating the episomal nucleic acid molecule to promote degradation of the episomal nucleic acid molecule.

In any of the methods, compositions, complexes, chiRNAs or DNA polynucleotide molecules described herein, when present as RNA within in the cell the guide sequence may be capable of hybridizing to a sequence of the target viral nucleic acid which is integrated into the genome of the organism and wherein said manipulation is a manipulation of the integrated target nucleic acid.

In any of the methods, compositions, complexes, chiRNAs or DNA polynucleotide molecules described herein, when formed within the cell the CRISPR/Cas complex may be capable of manipulating the integrated nucleic acid to promote excision of all or part of the target viral nucleic acid from the genome of the organism.

Any of the compositions, complexes, chiRNAs or DNA polynucleotide molecules described herein may be used in the manipulation of at least one target viral nucleic acid within the cell of a eukaryotic organism as described herein. Such a use may be in vitro and ex vivo.

In any of the methods, compositions, complexes, chiRNAs, DNA polynucleotide molecules or uses described herein at least one target viral nucleic acid may be comprised in a double-stranded DNA molecule polynucleotide cccDNA and/or viral DNA integrated into the genome of the organism, in which case the manipulation of the at least one target viral nucleic acid by the CRISPR-Cas complex comprises cleavage of viral cccDNA and/or integrated viral DNA. The cleavage may comprise one or more double-strand break(s) introduced into the viral cccDNA and/or integrated viral DNA, optionally at least two double-strand break(s). The cleavage may comprise one or more single-strand break(s) introduced into the viral cccDNA and/or integrated viral DNA, optionally at least two single-strand break(s).

In any of the methods, compositions, complexes, chiRNAs, DNA polynucleotide molecules or uses described herein, one or more double-strand break(s) and/or one or more single-strand break(s) may lead to the formation of one or more insertion and deletion mutations (INDELs) in the target viral cccDNA sequences and/or target integrated viral DNA sequences. The presence of INDELs may be assessed by SURVEYOR assay as described herein.

In any of the methods, compositions, complexes, chiRNAs, DNA polynucleotide molecules or uses described herein, cleavage of the viral cccDNA sequences or viral DNA sequences integrated in the genome of the organism may lead to excision of viral polynucleotide sequences from the cccDNA thereby reducing viral infection or excision of viral DNA sequences from the genome of the organism thereby reducing viral infection.

In methods or compositions or other embodiments of the invention which promote the formation of double-strand breaks the composition may comprise components of at least two types of CRISPR/Cas complex, wherein each type of complex comprises a guide sequence capable of hybridizing to different sequences of the target nucleic acid, wherein said cleavage is cleavage of first and second strands of the viral DNA via at least two double-strand breaks introduced into the viral cccDNA and/or into or adjacent viral DNA integrated into the genome of the organism;

wherein a first double-strand break is introduced at a first position of the DNA by manipulating a first target sequence and a second double-strand break is introduced at a second position of the DNA by manipulating a second target sequence;

wherein upon introduction of first and second double-strand breaks viral sequences between first and second double-strand breaks are excised from cccDNA and/or from the genomic DNA of the organism.

In methods or compositions or other embodiments of the invention which promote the formation of single-strand breaks, the composition may comprise components of at least four types of CRISPR/Cas complex, wherein each type of complex comprises a guide sequence capable of hybridizing to different sequences of the target nucleic acid, wherein said cleavage is via at least two pairs of single-strand breaks introduced into the viral cccDNA and/or introduced into or adjacent viral DNA integrated into the genome of the organism;

wherein to introduce a first pair of single-strand breaks a first single-strand break is introduced into a first strand of DNA by manipulating a first target sequence to create a first nick and a second single-strand break is introduced into the opposite strand of DNA by manipulating a second target sequence to create a second nick;

wherein to introduce a second pair of single-strand breaks a third single-strand break is introduced into said first strand of DNA by manipulating a third target sequence to create a third nick and a fourth single-strand break is introduced into said opposite strand of DNA by manipulating a fourth target sequence to create a fourth nick;

wherein upon introduction of first and second pairs of single-strand breaks viral sequences between first and second pairs of single-strand breaks are excised from cccDNA and/or from the genomic DNA of the organism.

The first and second nicks may be offset relative to each other by at least one base pair of the duplex creating a first overhang, and wherein third and fourth nicks are offset relative to each other by at least one base pair of the duplex creating a second overhang. Following excision of viral sequences the ends of the cleaved first strand of DNA may be ligated together and the ends of the cleaved second strand of DNA may be ligated together thus reforming unbroken first and second strands.

In methods or compositions or other embodiments of the invention which promote the formation of single-strand breaks the single-strand break(s) may be introduced into DNA by a nickase enzyme which is a modified Cas9 enzyme comprising a substitution leading to catalytic inactivation of the HNH nuclease domain or the RuvC nuclease domain of Cas9; optionally wherein the substitution is at position D10 of SpCas9, preferably a D10A substitution or substitution of a residue corresponding to position D10 in a SpCas9-related enzyme, or wherein the substitution is at position H840 of SpCas9, preferably a H840A substitution or substitution of a residue corresponding to position H840 in a SpCas9-related enzyme.

In any of the methods, compositions, complexes, chiRNAs, DNA polynucleotide molecules or uses described herein, target viral nucleic acid may be cccDNA and/or viral DNA integrated into the genome of the organism and wherein said manipulation comprises insertion of one or more nucleotides into or adjacent viral cccDNA sequences or into or adjacent integrated viral DNA sequences, deletion of one or more nucleotides of viral cccDNA or of integrated viral DNA, translocation of viral cccDNA sequences or of integrated viral DNA sequences, repression of transcription of viral cccDNA sequences or of integrated viral DNA sequences, and/or inactivation of viral cccDNA sequences or of integrated viral DNA sequences. Repression of transcription of viral cccDNA sequences and/or integrated viral DNA sequences may be effected by the action of a CRISPR-Cas system comprising a CRISPR enzyme fused to one or more transcriptional repressor domains, optionally wherein the one or more transcriptional repressor domains comprises KRAB, SID and/or SID4X, preferably wherein the CRISPR enzyme is a Cas9 enzyme. The manipulation may comprise activation of genes carried by viral cccDNA, e.g. by the action of a CRISPR-Cas system comprising a deactivated CRISPR enzyme fused to one or more transcriptional activation domains such as VP64, preferably the viral cccDNA is HBV and activation results in increased activity of APOBEC3A and/or APOBEC3B, and or other viral interferon-stimulated genes (ISGs), thereby leading to a reduction in HBV cccDNA. Manipulation of nucleotide sequences of viral cccDNA or integrated viral DNA may lead to disruption of one or more viral open reading frames, disruption of viral mRNA expression and/or inhibition of the production of functional virions.

In any of the methods, compositions, complexes, chiRNAs, DNA polynucleotide molecules or uses described herein, manipulation of said viral cccDNA may lead to a reduction in the level of one or more of viral rcDNA, viral cccDNA and viral ssDNA compared to the level in the absence of the CRISPR/Cas complex.

In any of the methods, compositions, complexes, chiRNAs, DNA polynucleotide molecules or uses described herein, the effect of said manipulation may comprise inhibiting the production of new virions.

In any of the methods, compositions, complexes, chiRNAs, DNA polynucleotide molecules or uses described herein, the effect of said modifying may comprise removing viral sequences from said organism thereby reducing viral infection.

In any of the methods and compositions described herein, the described composition may further comprises components of one or more additional CRISPR/Cas complexes, or components required for the assembly of one or more additional CRISPR/Cas complexes, wherein each type of complex comprises a different guide sequence capable hybridizing to a different sequence of the target nucleic acid within the cell. Thus, any of the methods and compositions described herein may be additionally characterized by one or more additional CRISPR/Cas complexes each of which one or more additional CRISPR/Cas complexes may be characterized as described herein.

In any of the methods, compositions, complexes, chiRNAs, DNA polynucleotide molecules or uses described herein, the target viral nucleic acid may be a hepatitis B virus (HBV) nucleic acid. Where the target viral nucleic acid is a hepatitis B virus (HBV) nucleic acid, the cell of the organism is a cell capable of being infected by HBV. The cell may be a cell which expresses the sodium taurocholate cotransporting polypeptide (NTCP). The cell may be a hepatocyte, preferably a primary hepatocyte, more preferably a human hepatocyte or a human primary hepatocyte, a HepG2.2.15 or a HepG2-hNTCP cell.

When the target viral nucleic acid is a hepatitis B virus (HBV) nucleic acid the guide sequence may be capable of hybridizing with target viral nucleic acids of HBV ORF S, ORF C, ORF P, or ORF X, preferably ORF C, optionally wherein the sequence of the guide sequence comprises 5'-gggcgcacctctctttacg-3' (SEQ ID NO: 1750), 5'-cctctgccgatccatactg-3' (SEQ ID NO: 1472) or 5'-taaagaatttggagctactg-3' (SEQ ID NO: 1566).

In the methods, compositions, complexes, chiRNAs, DNA polynucleotide molecules or uses described herein, the target viral nucleic acid may be a human papillomavirus (HPV) nucleic acid, an Epstein Barr virus (EBV) nucleic acid, a herpes simplex virus (HSV) nucleic acid, or a varicella zoster virus (VZV) nucleic acid.

In any of the methods, compositions, complexes, chiRNAs, DNA polynucleotide molecules or uses described herein, said manipulation may be performed in vitro or ex vivo.

Any of the compositions, complexes, chiRNAs or DNA polynucleotide molecules described herein may be described for use as a medicament.

Any of the compositions, complexes, chiRNAs or DNA polynucleotide molecules described herein may be described for use in the treatment of a viral infection. Such a treatment may be of a viral infection wherein target viral sequences are comprised in an episomal nucleic acid molecule which is not integrated into the genome of the organism, such as a covalently closed circular DNA (cccDNA). The viral infection may caused by hepatitis B virus (HBV), human papillomavirus (HPV), Epstein Barr virus (EBV), herpes simplex virus (HSV) or varicella zoster virus (VZV).

Any of the compositions, complexes, chiRNAs or DNA polynucleotide molecules described herein may be described for use as a medicament or for use in the treatment of a viral infection wherein the organism is a mammal such as a human.

Any of the compositions, complexes, chiRNAs or DNA polynucleotide molecules described herein may be described for use in the manufacture of a medicament.

Any of the compositions, complexes, chiRNAs or DNA polynucleotide molecules described herein may be described for use in the manufacture of a medicament for the treatment of a viral infection. Such a treatment may be of a viral infection wherein target viral sequences are comprised in an episomal nucleic acid molecule which is not integrated into the genome of the organism, such as a covalently closed circular DNA (cccDNA). The viral infection may be caused by hepatitis B virus (HBV) or the viral infection may be caused by human papillomavirus (HPV), Epstein Barr virus (EBV), herpes simplex virus (HSV), or varicella zoster virus (VZV). In any such uses the organism may be a mammal such as a human.

The invention also relates to a method of modifying a cell, of a eukaryotic organism by manipulating at least one target viral nucleic acid within the cell, the method comprising introducing into the cell an exogenous composition capable of forming a Clustered Regularly Interspersed Short Palindromic Repeats (CRISPR)-CRISPR-associated (Cas) (CRISPR-Cas) complex, the composition comprising:
- (A) CRISPR-Cas system polynucleotide sequences comprising:
  - (i) a guide sequence, which when transcribed is capable of hybridizing to a sequence of the at least one target viral nucleic acid to be manipulated;
  - (ii) a trans-activating CRISPR RNA (tracr) mate sequence, which is linked to the guide sequence; and
  - (iii) a tracr sequence, wherein when transcribed all or a portion of the tracr sequence is capable of hybridizing to the tracr mate sequence; and
- (B) a CRISPR/Cas enzyme or a polynucleotide encoding a CRISPR/Cas enzyme, wherein when the CRISPR/Cas system polynucleotide sequences are present as RNA within the cell and the CRISPR/Cas enzyme is present as a protein within the cell:
  - (i) the tracr mate sequence is hybridized to the tracr sequence or portion thereof;
  - (ii) the CRISPR/Cas system polynucleotide sequences are associated with the CRISPR/Cas enzyme, so forming a CRISPR/Cas complex; and
  - (iii) the guide sequence hybridizes to a sequence of the at least one target viral nucleic acid thereby directing sequence-specific binding of the CRISPR/Cas complex to the at least one sequence of the target viral nucleic acid, whereupon said sequence of said target viral nucleic acid is manipulated by the CRISPR/Cas enzyme of the complex.

In relation to such a method the cell may be a cell which expresses the sodium taurocholate cotransporting polypeptide (NTCP), preferably the cell may be a hepatocyte; the tracr sequence has one or more hairpins and is 30 or more nucleotides in length, 40 or more nucleotides in length, or 50 or more nucleotides in length; the guide sequence is between 10 to 30 nucleotides in length, the CRISPR/Cas enzyme is a Type II Cas9 enzyme; the target viral nucleic acid is comprised in an HBV episomal nucleic acid which is not integrated into the genome of the organism and is an HBV double-stranded covalently closed circular DNA (cccDNA). Such a method may be additionally characterized, as appropriate, in accordance with any of the further and particular features as described herein.

The invention also relates to an exogenous composition which, when introduced into a cell of a eukaryotic organism, is capable of forming at least one Clustered Regularly Interspersed Short Palindromic Repeats (CRISPR)-CRISPR-associated (Cas) (CRISPR-Cas) complex, wherein the complex is capable of modifying the cell by manipulating at least one target viral nucleic acid within the cell, the composition comprising:
- (A) Clustered Regularly Interspersed Short Palindromic Repeats (CRISPR)-CRISPR associated (Cas) (CRISPR-Cas) system polynucleotide sequences comprising:
  - (i) a guide sequence, which when transcribed is capable of hybridizing to a sequence of the at least one target viral nucleic acid to be manipulated;
  - (ii) a trans-activating CRISPR RNA (tracr) mate sequence, which is linked to the guide sequence; and
  - (iii) a tracr sequence, wherein when transcribed all or a portion of the tracr sequence is capable of hybridizing with the tracr mate sequence; and
- (B) a CRISPR/Cas enzyme or a polynucleotide encoding a CRISPR/Cas enzyme, wherein when the CRISPR/Cas system polynucleotide sequences are present as RNA within the cell and the CRISPR/Cas enzyme is present as a protein within the cell:
  - (i) the tracr mate sequence is hybridized to the tracr sequence or portion thereof;
  - (ii) the CRISPR/Cas system polynucleotide sequences are associated with the CRISPR/Cas enzyme, so forming a CRISPR/Cas complex; and
  - (iii) the guide sequence hybridizes to a sequence of the at least one target viral nucleic acid thereby directing sequence-specific binding of the CRISPR/Cas complex to the at least one sequence of the target viral nucleic acid, whereupon said sequence of said target viral nucleic acid is manipulated by the CRISPR/Cas enzyme of the complex.

In relation to such a composition the cell may be a cell which expresses the sodium taurocholate cotransporting polypeptide (NTCP), preferably the cell may be a hepatocyte; the tracr sequence has one or more hairpins and is 30 or more nucleotides in length, 40 or more nucleotides in length, or 50 or more nucleotides in length; the guide sequence is between 10 to 30 nucleotides in length, the CRISPR/Cas enzyme is a Type II Cas9 enzyme; the target viral nucleic acid is comprised in an HBV episomal nucleic acid which is not integrated into the genome of the organism and is an HBV double-stranded covalently closed circular DNA (cccDNA). Such a composition may be additionally characterized, as appropriate, in accordance with any of the further and particular features as described herein.

The invention also relates to a Clustered Regularly Interspersed Short Palindromic Repeats (CRISPR)-CRISPR-associated (Cas) (CRISPR-Cas) complex which, when introduced into a cell of a eukaryotic organism, is capable of modifying the cell by manipulating a target viral nucleic acid within the cell, the complex comprising:
- (A) CRISPR-Cas system RNA polynucleotide sequences comprising:
  - (i) a guide sequence, which is capable of hybridizing to a sequence of the target viral nucleic acid to be manipulated;
  - (ii) a trans-activating CRISPR RNA (tracr) mate sequence, which is linked to the guide sequence; and
  - (iii) a tracr sequence, wherein all or a portion of the tracr sequence is capable of hybridizing with the tracr mate sequence; and (B) a CRISPR/Cas enzyme,
wherein when the CRISPR/Cas system RNA polynucleotide sequences and the CRISPR/Cas enzyme are present within the cell:
   (i) the tracr mate sequence is hybridized to the tracr sequence or portion thereof;
   (ii) the CRISPR/Cas system polynucleotide sequences are associated with the CRISPR/Cas enzyme, so forming a CRISPR/Cas complex; and
   (iii) the guide sequence hybridizes to a sequence of the target viral nucleic acid thereby directing sequence-specific binding of the CRISPR/Cas complex to the sequence of the target viral nucleic acid, whereupon said sequence of said target viral nucleic acid is manipulated by the CRISPR/Cas enzyme of the complex.

In relation to such a complex the cell may be a cell which expresses the sodium taurocholate cotransporting polypeptide (NTCP), preferably the cell may be a hepatocyte; the tracr sequence has one or more hairpins and is 30 or more nucleotides in length, 40 or more nucleotides in length, or 50 or more nucleotides in length; the guide sequence is between 10 to 30 nucleotides in length, the CRISPR/Cas enzyme is a Type II Cas9 enzyme; the target viral nucleic acid is comprised in an HBV episomal nucleic acid which is not integrated into the genome of the organism and is an HBV double-stranded covalently closed circular DNA (cccDNA). Such a complex may be additionally characterized, as appropriate, in accordance with any of the further and particular features as described herein.

The invention also relates to a Clustered Regularly Interspersed Short Palindromic Repeats (CRISPR)-CRISPR-associated (Cas) (CRISPR-Cas) system chimeric RNA polynucleotide molecule (chiRNA) which, when introduced into a cell of a eukaryotic organism, is capable of associating with a CRISPR/Cas enzyme so forming a CRISPR-Cas complex, wherein the CRISPR-Cas complex is capable of modifying the cell by manipulating a target viral nucleic acid within the cell; the chiRNA comprising:
   (i) a guide sequence, which is capable of hybridizing to a sequence of the target viral nucleic acid to be manipulated;
   (ii) a trans-activating CRISPR RNA (tracr) mate sequence, which is linked to the guide sequence; and
   (iii) a tracr sequence, wherein all or a portion of the tracr sequence is capable of hybridizing with the tracr mate sequence; and
wherein when the chiRNA and the CRISPR/Cas enzyme are present within the cell:
   a) the tracr mate sequence hybridizes to the tracr sequence or portion thereof;
   b) the chiRNA associates with the CRISPR/Cas enzyme, so forming the CRISPR/Cas complex; and
   c) the guide sequence hybridizes to a sequence of the target viral nucleic acid thereby directing sequence-specific binding of the CRISPR/Cas complex to the sequence of the target viral nucleic acid whereupon said sequence of said target viral nucleic acid is manipulated by the CRISPR/Cas enzyme of the complex.

In relation to such a chiRNA, the cell may be a cell which expresses the sodium taurocholate cotransporting polypeptide (NTCP), preferably the cell may be a hepatocyte; the tracr sequence has one or more hairpins and is 30 or more nucleotides in length, 40 or more nucleotides in length, or 50 or more nucleotides in length; the guide sequence is between 10 to 30 nucleotides in length, the CRISPR/Cas enzyme is a Type II Cas9 enzyme; the target viral nucleic acid is comprised in an HBV episomal nucleic acid which is not integrated into the genome of the organism and is an HBV double-stranded covalently closed circular DNA (cccDNA). Such a chiRNA may be additionally characterized, as appropriate, in accordance with any of the further and particular features as described herein.

The invention also relates to a DNA polynucleotide molecule comprising sequences encoding a Clustered Regularly Interspersed Short Palindromic Repeats (CRISPR)-CRISPR-associated (Cas) (CRISPR-Cas) system chimeric RNA polynucleotide molecule (chiRNA), wherein upon introduction of said chiRNA into a cell of a eukaryotic organism said chiRNA is capable of associating with a CRISPR/Cas enzyme so forming a CRISPR-Cas complex, wherein the CRISPR-Cas complex is capable of modifying the cell by manipulating a target viral nucleic acid within the cell; the chiRNA comprising:
   (i) a guide sequence, which is capable of hybridizing to a sequence of the target viral nucleic acid to be manipulated;
   (ii) a trans-activating CRISPR RNA (tracr) mate sequence, which is linked to the guide sequence; and
   (iii) a tracr sequence, wherein all or a portion of the tracr sequence is capable of hybridizing with the tracr mate sequence; and
wherein when the chiRNA and the CRISPR/Cas enzyme are present within the cell:
   a) the tracr mate sequence hybridizes to the tracr sequence or portion thereof;
   b) the chiRNA associates with the CRISPR/Cas enzyme, so forming the CRISPR/Cas complex; and
   c) the guide sequence hybridizes to a sequence of the target viral nucleic acid thereby directing sequence-specific binding of the CRISPR/Cas complex to the sequence of the target viral nucleic acid whereupon said sequence of said target viral nucleic acid is manipulated by the CRISPR/Cas enzyme of the complex.

In relation to such a DNA, the cell may be a cell which expresses the sodium taurocholate cotransporting polypeptide (NTCP), preferably the cell may be a hepatocyte; the tracr sequence has one or more hairpins and is 30 or more nucleotides in length, 40 or more nucleotides in length, or 50 or more nucleotides in length; the guide sequence is between 10 to 30 nucleotides in length, the CRISPR/Cas enzyme is a Type II Cas9 enzyme; the target viral nucleic acid is comprised in an HBV episomal nucleic acid which is not integrated into the genome of the organism and is an HBV double-stranded covalently closed circular DNA (cccDNA). Such a DNA may be additionally characterized, as appropriate, in accordance with any of the further and particular features as described herein.

Certain methods, products and uses described herein may not be applied in situations which result in the destruction of a human embryo and in situations which result in the modification of the germ line genetic identity of humans. Methods, products and uses described herein may be used for non-therapeutic purposes. Furthermore, any of the methods described herein may be applied in vitro and ex vivo.

It will be appreciated that the invention described herein involves various components which may display variations in their specific characteristics. It will be appreciated that any combination of features described above and herein, as appropriate, are contemplated as a means for implementing the invention.

Furthermore, it is an object of the invention to not encompass within the invention any previously known product, process of making the product, or method of using the product such that Applicants reserve the right and hereby disclose a disclaimer of any previously known product, process, or method. It is further noted that the invention does not intend to encompass within the scope of the invention any product, process, or making of the product or method of using the product, which does not meet the written description and enablement requirements of the USPTO (35 U.S.C. § 112, first paragraph) or the EPO (Article 83 of the EPC), such that Applicants reserve the right and hereby disclose a disclaimer of any such cubject matter.

It is noted that in this disclosure and particularly in the claims and/or paragraphs, terms such as "comprises", "comprised", "comprising" and the like can have the meaning attributed to it in U.S. Patent law; e.g., they can mean "includes", "included", "including", and the like; and that terms such as "consisting essentially of" and "consists essentially of" have the meaning ascribed to them in U.S. Patent law, e.g., they allow for elements not explicitly recited, but exclude elements that are found in the prior art or that affect a basic or novel characteristic of the invention. It may be advantageous in the practice of the invention to be in compliance with Art. 53(c) EPC and Rule 28(b) and (c) EPC. Nothing herein is intended as a promise.

These and other embodiments are disclosed or are obvious from and encompassed by, the following Detailed Description.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 2A-F shows an exemplary CRISPR system, a possible mechanism of action, an example adaptation for expression in eukaryotic cells, and results of tests assessing nuclear localization and CRISPR activity. FIG. 2C discloses SEQ ID NOS 1581 and 1582, respectively, in order of appearance. FIG. 2E discloses SEQ ID NOS 1583-1585, respectively, in order of appearance. FIG. 2F discloses SEQ ID NOS 1586-1590, respectively, in order of appearance.

FIG. 3A-D shows results of an evaluation of SpCas9 specificity for an example target. FIG. 3A discloses SEQ ID NOS 1591, 1584 and 1592-1602, respectively, in order of appearance. FIG. 3C discloses SEQ ID NO: 1591.

FIG. 4E discloses SEQ ID NO: 1603. FIG. 4F discloses SEQ ID NOS 1604 and 1605, respectively, in order of appearance. FIG. 4G discloses SEQ ID NOS 1606-1610, respectively, in order of appearance.

FIG. 5 provides a table of protospacer sequences (SEQ ID NOS 1611-1626, respectively, in order of appearance) and summarizes modification efficiency results for protospacer targets designed based on exemplary *S. pyogenes* and *S. thermophilus* CRISPR systems with corresponding PAMs against loci in human and mouse genomes. Cells were transfected with Cas9 and either pre-crRNA/tracrRNA or chimeric RNA, and analyzed 72 hours after transfection. Percent indels are calculated based on Surveyor assay results from indicated cell lines (N=3 for all protospacer targets, errors are S.E.M., N.D. indicates not detectable using the Surveyor assay, and N.T. indicates not tested in this study).

FIG. 6A discloses SEQ ID NOS 1627 and 1628, respectively, in order of appearance.

FIG. 8A-B shows exemplary bicistronic expression vectors for expression of CRISPR system elements in eukaryotic cells. FIG. 8A discloses SEQ ID NOS 1629-1631, respectively, in order of appearance. FIG. 8B discloses SEQ ID NOS 1632, 1541 and 1542, respectively, in order of appearance.

FIG. 9A-C shows histograms of distances between adjacent *S. pyogenes* SF370 locus 1 PAM (NGG) (FIG. 9A) and *S. thermophilus* LMD9 locus 2 PAM (NNAGAAW) (FIG. 9B) in the human genome; and distances for each PAM by chromosome (Chr) (FIG. 9C).

FIG. 10B discloses SEQ ID NOS 1633 and 1634, respectively, in order of appearance. FIG. 10C discloses SEQ ID NO: 1635.

FIG. 11A-C shows exemplary manipulations of a CRISPR system for targeting of genomic loci in mammalian cells. FIG. 11A discloses SEQ ID NO: 1636. FIG. 11B discloses SEQ ID NOS 1637-1639, respectively, in order of appearance. FIG. 11C depicts results of a Surveyor assay comparing the efficacy of Cas9-mediated cleavage at five protospacers in the human EMX1 locus.

FIG. 12A discloses SEQ ID NO: 1640.

FIG. 14 discloses SEQ ID NO: 1635.

FIG. 15 provides a table of sequences (SEQ ID NOS 1643-1650, 1550-1551 and 1651-1652, respectively, in order of appearance) for primers and probes used for Surveyor, RFLP, genomic sequencing, and Northern blot assays.

FIG. 16A discloses SEQ ID NO: 1653.

FIG. 18 discloses SEQ ID NOS 1654-1732, respectively, in order of appearance.

Figure 20A:
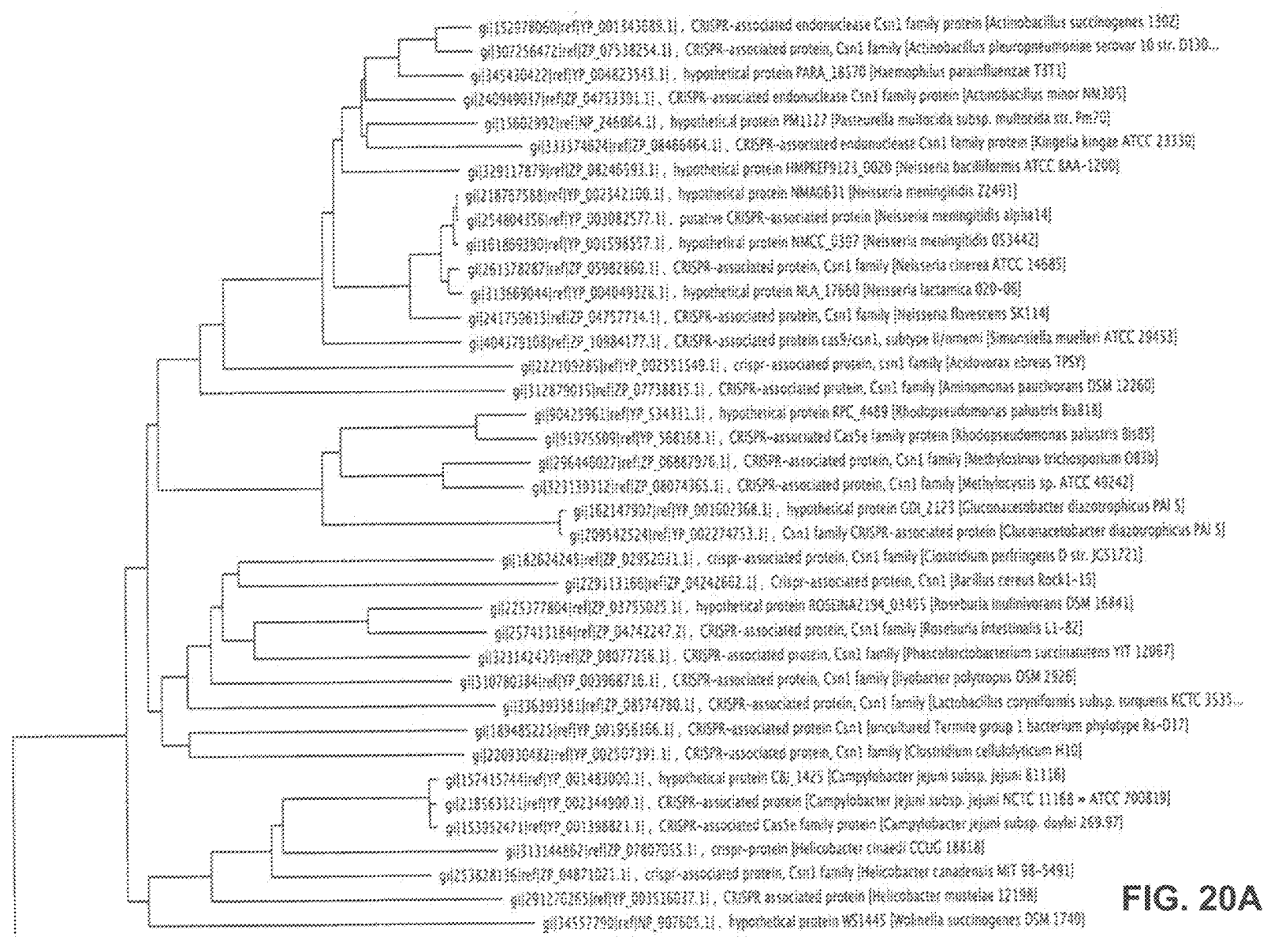
Figure 20B:
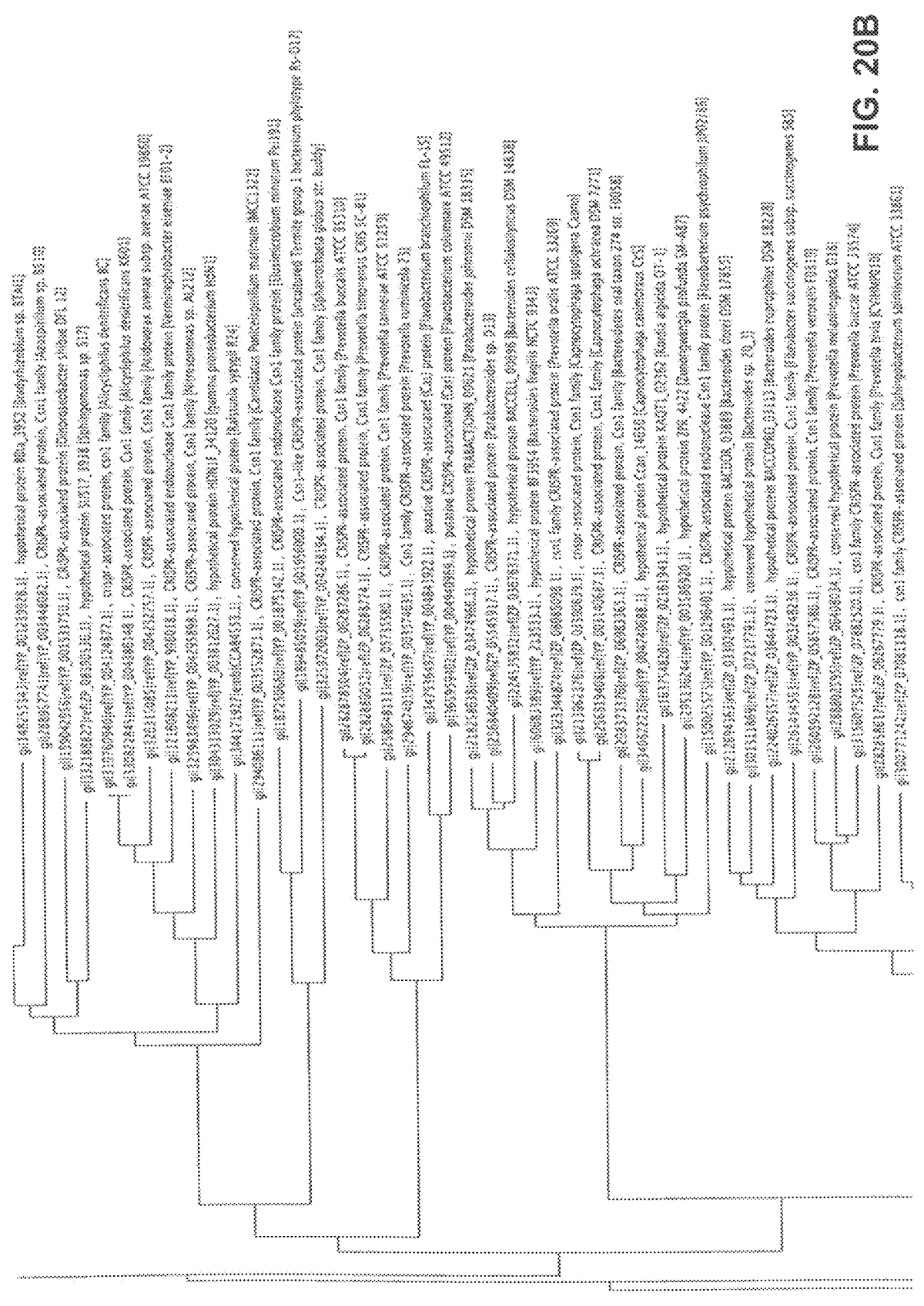

FIG. 20A-F shows the linear depiction of the phylogenetic analysis revealing five families of Cas9s, including three groups of large Cas9s (~1400 amino acids) and two of small Cas9s (~1100 amino acids).

FIG. 21C discloses SEQ ID NOS 1733-1735, 1733, 1736 and 1735, respectively, in order of appearance.

FIG. 22A discloses SEQ ID NOS 1737-1739, respectively, in order of appearance. FIG. 22B discloses SEQ ID NO: 1740.

Figure 24G:
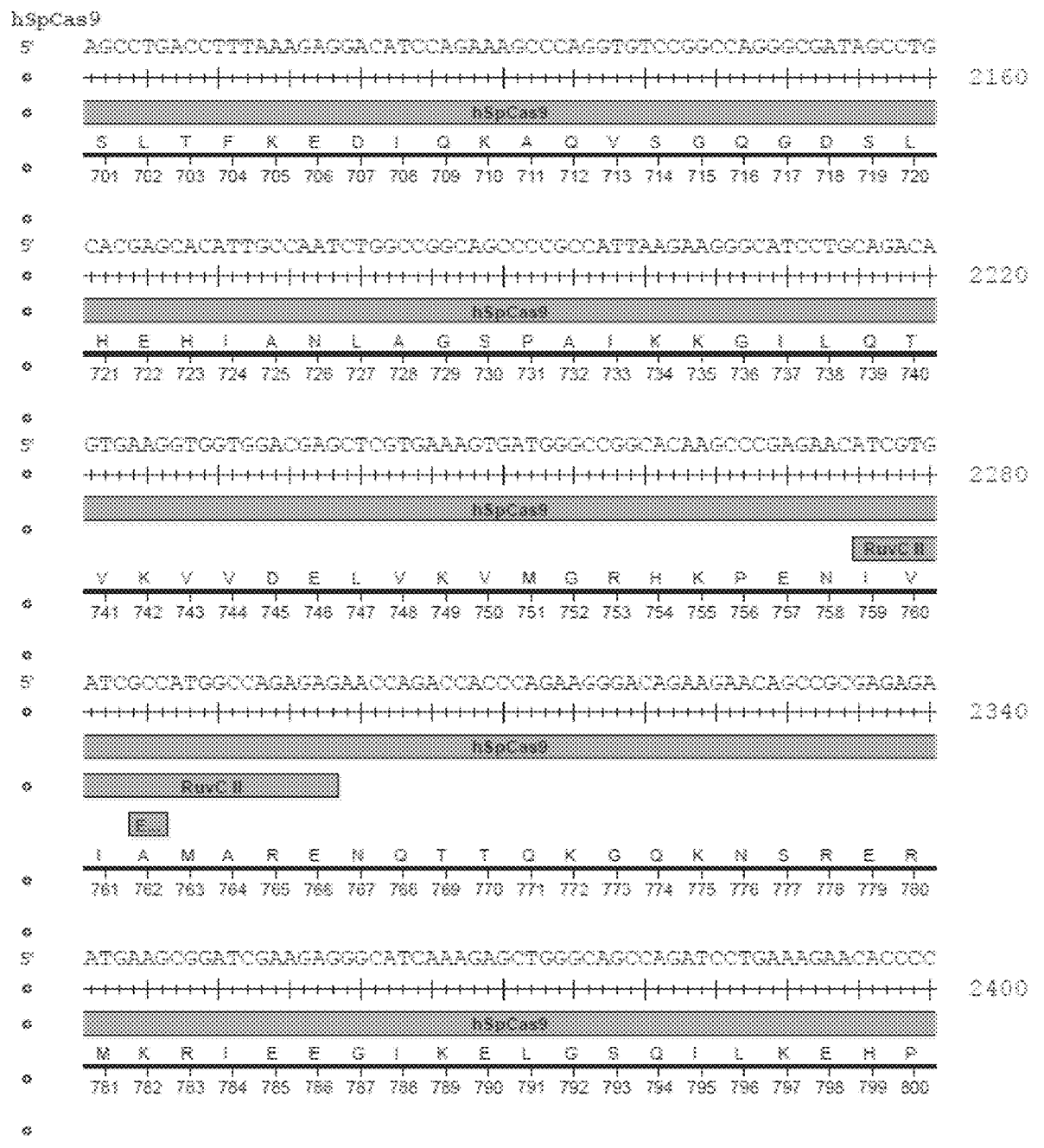

FIG. 24A-M shows sequences where the mutation points are located within the SpCas9 gene. FIG. 24A-M discloses the nucleotide sequence as SEQ ID NO: 1741 and the amino acid sequence as SEQ ID NO: 1742.

FIG. 27 shows delivery and in vivo mouse brain Cas9 expression data.

FIG. 28A-C shows RNA delivery of Cas9 and chimeric RNA into cells (A) Delivery of a GFP reporter as either DNA or mRNA into Neuro-2A cells. (B) Delivery of Cas9 and chimeric RNA against the Icam2 gene as RNA results in cutting for one of two spacers tested. (C) Delivery of Cas9 and chimeric RNA against the F7 gene as RNA results in cutting for one of two spacers tested.

FIG. 30B discloses SEQ ID NOS 1733-1735, 1733, 1736 and 1735, respectively, in order of appearance.

FIG. 31A discloses the nucleotide sequence as SEQ ID NO: 1743 and the amino acid sequence as 1744. FIG. 31B discloses SEQ ID NO: 1653. FIG. 31C discloses the nucleotide sequence as SEQ ID NO: 1745 and the amino acid sequence as SEQ ID NO: 1746.

FIG. 64A-B shows HBV DNA and cccDNA reductions upon long-term CRISPR/Cas expression are produced with multiple guides. (a) cccDNA reductions at 21 and 36 days post transduction across 3 guides (6, 17, and 21); large reductions are seen in each. (b) Total HBV DNA reductions at 21 and 36 days post transduction are also large across these 3 guide RNAs.

Figure 1:
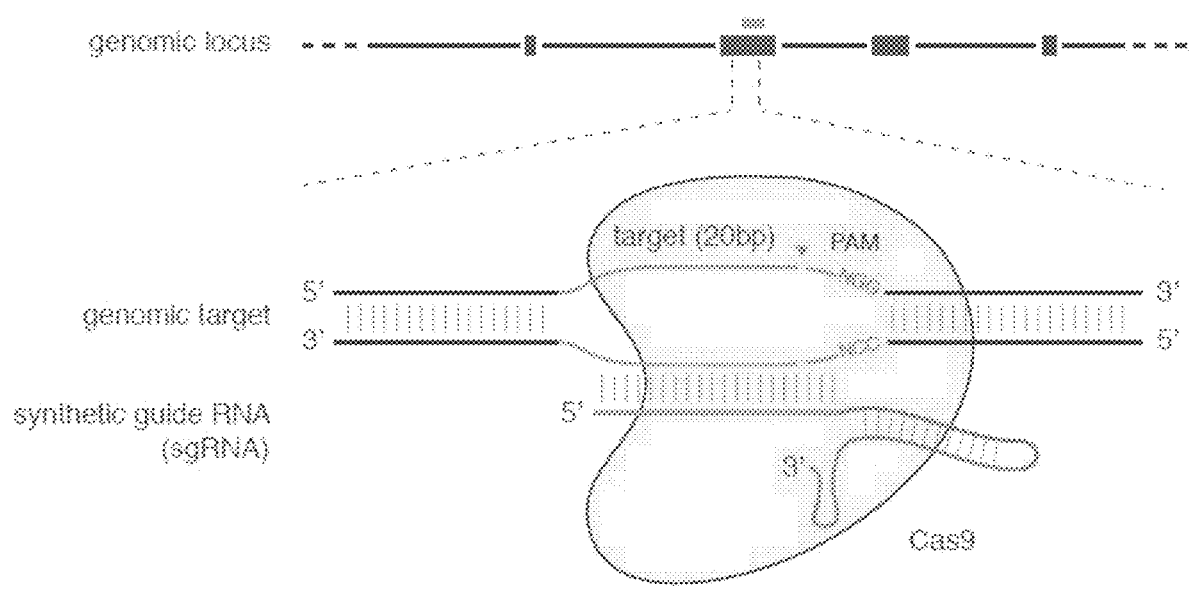
FIG. 1 shows a schematic model of the CRISPR system. The Cas9 nuclease from *Streptococcus pyogenes* (yellow) is targeted to genomic DNA by a synthetic guide RNA (sgRNA) consisting of a 20-nt guide sequence (blue) and a scaffold (red). The guide sequence base-pairs with the DNA target (blue), directly upstream of a requisite 5'-NGG protospacer adjacent motif (PAM; magenta), and Cas9 mediates a double-stranded break (DSB) ~3 bp upstream of the PAM (red triangle).

The figures herein are for illustrative purposes only and are not necessarily drawn to scale.

DETAILED DESCRIPTION OF THE INVENTION

With respect to general information on CRISPR-Cas Systems, components thereof, and delivery of such components, including methods, materials, delivery vehicles, vectors, particles, AAV, and making and using thereof, including as to amounts and formulations, all useful in the practice of the instant invention, reference is made to: U.S. Pat. Nos. 8,697,359, 8,771,945, 8,795,965, 8,865,406, 8,871,445, 8,889,356, 8,889,418 and 8,895,308; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); European Patent Applications EP 2 771 468 (EP13818570.7), EP 2 764 103 (EP13824232.6), and EP 2 784 162 (EP14170383.5); and PCT Patent Publications WO 2014/093661 (PCT/US2013/074743), WO 2014/093694 (PCT/US2013/074790), WO 2014/093595 (PCT/US2013/074611), WO 2014/093718 (PCT/US2013/074825), WO 2014/093709 (PCT/US2013/074812), WO 2014/093622 (PCT/US2013/074667), WO 2014/093635 (PCT/US2013/074691), WO 2014/093655 (PCT/US2013/074736), WO 2014/093712 (PCT/US2013/074819), WO2014/093701 (PCT/US2013/074800), and WO2014/018423 (PCT/US2013/051418). Reference is also made to U.S. provisional patent applications 61/758,468; 61/802,174; 61/806,375; 61/814,263; 61/819,803 and 61/828,130, filed on Jan. 30, 2013; Mar. 15, 2013; Mar. 28, 2013; Apr. 20, 2013; May 6, 2013 and May 28, 2013 respectively. Reference is also made to U.S. provisional patent application 61/836,123, filed on Jun. 17, 2013. Reference is additionally made to U.S. provisional patent applications 61/835,931, 61/835,936, 61/836,127, 61/836,101, 61/836,080 and 61/835,973, each filed Jun. 17, 2013. Further reference is made to U.S. provisional patent applications 61/862,468 and 61/862,355 filed on Aug. 5, 2013; 61/871,301 filed on Aug. 28, 2013; 61/960,777 filed on Sep. 25, 2013 and 61/961,980 filed on Oct. 28, 2013. Reference is yet further made to: PCT Patent applications Nos: PCT/US2014/041803, PCT/US2014/041800, PCT/US2014/041809, PCT/US2014/041804 and PCT/US2014/041806, each filed Jun. 10, 2014 6/10/14; PCT/US2014/041808 filed Jun. 11, 2014; and PCT/US2014/62558 filed Oct. 28, 2014, and U.S. Provisional Patent Applications Ser. Nos. 61/915,150, 61/915,301, 61/915,267 and 61/915,260, each filed Dec. 12, 2013; 61/757,972 and 61/768,959, filed on Jan. 29, 2013 and Feb. 25, 2013; 61/835,936, 61/836,127, 61/836,101, 61/836,080, 61/835,973, and 61/835,931, filed Jun. 17, 2013; 62/010,888 and 62/010,879, both filed Jun. 11, 2014; 62/010,329 and 62/010,441, each filed Jun. 10, 2014; 61/939,228 and 61/939,242, each filed Feb. 12, 2014; 61/980,012, filed Apr. 15, 2014; 62/038,358, filed Aug. 17, 2014; 62/054,490, 62/055,484, 62/055,460 and 62/055,487, each filed Sep. 25, 2014; and 62/069,243, filed Oct. 27, 2014. Reference is also made to U.S. provisional patent applications Nos. 62/055,484, 62/055,460, and 62/055,487, filed Sep. 25, 2014; U.S. provisional patent application 61/980,012, filed Apr. 15, 2014; and U.S. provisional patent application 61/939,242 filed Feb. 12, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Reference is made to US provisional patent application U.S. Ser. No. 61/980,012 filed Apr. 15, 2014. Reference is made to PCT application designating, inter alia, the United States, application No. PCT/US14/41806, filed Jun. 10, 2014. Reference is made to U.S. provisional patent application 61/930,214 filed on Jan. 22, 2014. Reference is made to U.S. provisional patent applications 61/915,251; 61/915,260 and 61/915,267, each filed on Dec. 12, 2013. Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Also with respect to general information on CRISPR-Cas Systems, mention is made of the following (also hereby incorporated herein by reference):

*Multiplex genome engineering using CRISPR Cas systems.* Cong, L., Ran, F. A., Cox, D., Lin, S., Barretto, R., Habib, N., Hsu, P. D., Wu, X., Jiang, W., Marraffini, L. A., & Zhang, F. Science Feb 15;339(6121):819-23 (2013);

*RNA-guided editing of bacterial genomes using CRISPR-Cas systems.* Jiang W., Bikard D., Cox D., Zhang F, Marraffini L A. Nat Biotechnol Mar;31(3):233-9 (2013);

*One-Step Generation of Mice Carrying Mutations in Multiple Genes by CRISPR Cas-Mediated Genome Engineering.* Wang H., Yang H., Shivalila C S., Dawlaty M M., Cheng A W., Zhang F., Jaenisch R. Cell May 9;153(4): 910-8 (2013);

*Optical control of mammalian endogenous transcription and epigenetic states.* Konermann S, Brigham M D, Trevino A E, Hsu P D, Heidenreich M, Cong L, Platt R J, Scott D A, Church G M, Zhang F. Nature. 2013 Aug. 22; 500(7463):472-6. doi: 10.1038/Nature12466. Epub 2013 Aug. 23;

*Double Nicking by RNA-Guided CRISPR Cas9 for Enhanced Genome Editing Specificity.* Ran, F A., Hsu, P D., Lin, C Y., Gootenberg, J S., Konermann, S., Trevino, A E., Scott, D A., Inoue, A., Matoba, S., Zhang, Y., & Zhang, F. Cell Aug 28. pii: S0092-8674(13)01015-5. (2013);

*DNA targeting specificity of RNA-guided Cas9 nucleases.* Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);

*Genome engineering using the CRISPR-Cas9 system.* Ran, F A., Hsu, P D., Wright, J., Agarwala, V., Scott, D A., Zhang, F. Nature Protocols Nov;8(11):2281-308. (2013);

*Genome-Scale CRISPR-Cas9 Knockout Screening in Human Cells.* Shalem, O., Sanjana, N E., Hartenian, E., Shi, X., Scott, DA., Mikkelson, T., Heckl, D., Ebert, B L., Root, D E., Doench, J G., Zhang, F. Science Dec 12. (2013). [Epub ahead of print];

*Crystal structure of cas9 in complex with guide RNA and target DNA.* Nishimasu, H., Ran, F A., Hsu, P D., Konermann, S., Shehata, S I., Dohmae, N., Ishitani, R., Zhang, F., Nureki, O. Cell Feb 27. (2014). 156(5):935-49;

*Genome-wide binding of the CRISPR endonuclease Cas9 in mammalian cells.* Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. (2014) Apr 20. doi: 10.1038/nbt.2889,

*CRISPR-Cas9 Knockin Mice for Genome Editing and Cancer Modeling,* Platt et al., Cell 159(2): 440-455 (2014) DOI: 10.1016/j.cell.2014.09.014,

*Development and Applications of CRISPR-Cas9 for Genome Engineering,* Hsu et al, Cell 157, 1262-1278 (Jun. 5, 2014) (Hsu 2014),

*Genetic screens in human cells using the CRISPR Cas9 system,* Wang et al., Science. 2014 Jan. 3; 343(6166): 80-84. doi:10.1126/science.1246981,

*Rational design of highly active sgRNAs for CRISPR-Cas9-mediated gene inactivation,* Doench et al., Nature Biotechnology published online 3 Sep. 2014; doi:10.1038/nbt.3026, and

*In vivo interrogation of gene function in the mammalian brain using CRISPR-Cas9,* Swiech et al, Nature Biotechnology; published online 19 Oct. 2014; doi:10.1038/nbt.3055.

each of which is incorporated herein by reference, and discussed briefly below:

Cong et al. engineered type II CRISPR/Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR/Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA:Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli,* 65% that were recovered contained the mutation.

Konermann et al. addressed the need in the art for versatile and robust technologies that enable optical and chemical modulation of DNA-binding domains based CRISPR Cas9 enzyme and also Transcriptional Activator Like Effectors Cas9 nuclease from the microbial CRISPR-Cas system is targeted to specific genomic loci by a 20 nt guide sequence, which can tolerate certain mismatches to the DNA target and thereby promote undesired off-target mutagenesis. To address this, Ran et al. described an approach that combined a Cas9 nickase mutant with paired guide RNAs to introduce targeted double-strand breaks. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors reported that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and sgRNA can be titrated to minimize off-target modification. Additionally, to facilitate mammalian genome engineering applications, the authors reported providing a web-based software tool to guide the selection and validation of target sequences as well as off-target analyses.

Ran et al. described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNA heteroduplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Hsu 2014 is a review article that discusses generally CRISPR-Cas9 history from yogurt to genome editing, including genetic screening of cells, that is in the information, data and findings of the applications in the lineage of this specification filed prior to Jun. 5, 2014. The general teachings of Hsu 2014 do not involve the specific models, animals of the instant specification.

Mention is also made of Tsai et al, "Dimeric CRISPR RNA-guided FokI nucleases for highly specific genome editing," Nature Biotechnology 32(6): 569-77 (2014) which is not believed to be prior art to the instant invention or application, but which may be considered in the practice of the instant invention.

In general, the CRISPR-Cas or CRISPR system is as used in the foregoing documents, such as WO 2014/093622 (PCT/US2013/074667) and refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or "RNA(s)" as that term is herein used (e.g., RNA(s) to guide Cas9, e.g. CRISPR RNA and transactivating (tracr) RNA or a single guide RNA (sgRNA) (chimeric RNA)) or other sequences and transcripts from a CRISPR locus. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise any polynucleotide, such as DNA or RNA polynucleotides. In some embodiments, a target sequence is located in the nucleus or cytoplasm of a cell. In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used.

In embodiments of the invention the terms guide sequence and guide RNA are used interchangeably as in foregoing cited documents such as WO 2014/093622 (PCT/US2013/074667). In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. Preferably the guide sequence is 10-30 nucleotides long. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art. A guide sequence may be selected to target any target sequence. In some embodiments, the target sequence is a sequence within a genome of a cell. Exemplary target sequences include those that are unique in the target genome. For example, for the S. pyogenes Cas9, a unique target sequence in a genome may include a Cas9 target site of the form MMMM MMMNNNNNNNNNNNNXGG (SEQ ID NO: 1) where NNNNNNNNNNNNXGG (SEQ ID NO: 2) (N is A, G, T, or C; and X can be anything) has a single occurrence in the genome. A unique target sequence in a genome may include an S. pyogenes Cas9 target site of the form MMMMMMMMMNNNNNNNNNNNXGG (SEQ ID NO: 3) where NNNNNNNNNNNXGG (SEQ ID NO: 4) (N is A, G, T, or C; and X can be anything) has a single occurrence in the genome. For the S. thermophilus CRISPR1 Cas9, a unique target sequence in a genome may include a Cas9 target site of the form MMMMMMMMNNNNNNNNNNNXXAGAAW (SEQ ID NO: 5) where NNNNNNNNNNNXXAGAAW (SEQ ID NO: 6) (N is A, G, T, or C; X can be anything; and W is A or T) has a single occurrence in the genome. A unique target sequence in a genome may include an S. thermophilus CRISPR1 Cas9 target site of the form MMMMMMMMMNNNNNNNNNNNXXAGAAW (SEQ ID NO: 7) where NNNNNNNNNNNXXAGAAW (SEQ ID NO: 8) (N is A, G, T, or C; X can be anything; and W is A or T) has a single occurrence in the genome. For the S. pyogenes Cas9, a unique target sequence in a genome may include a Cas9 target site of the form MMMMMMMMMNNNNNNNNNNNXGGXG (SEQ ID NO: 9) where NNNNNNNNNNNXGGXG (SEQ ID NO: 10) (N is A, G, T, or C; and X can be anything) has a single occurrence in the genome. A unique target sequence in a genome may include an S. pyogenes Cas9 target site of the form MMMMMM MMMNNNNNNNNNNNNXGGXG (SEQ ID NO: 11) where NNNNNNNNNNNNXGGXG (SEQ ID NO: 12) (N is A, G, T, or C; and X can be anything) has a single occurrence in the genome. In each of these sequences "M" may be A, G, T, or C, and need not be considered in identifying a sequence as unique. In some embodiments, a guide sequence is selected to reduce the degree secondary structure within the guide sequence. In some embodiments, about or less than about 75%, 50%, 40%, 30%, 25%, 20%, 15%, 10%, 5%, 1%, or fewer of the nucleotides of the guide sequence participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, Cell 106(1): 23-24; and P A Carr and G M Church, 2009, Nature Biotechnology 27(12): 1151-62).

In general, a tracr mate sequence includes any sequence that has sufficient complementarity with a tracr sequence to promote one or more of: (1) excision of a guide sequence flanked by tracr mate sequences in a cell containing the corresponding tracr sequence; and (2) formation of a CRISPR complex at a target sequence, wherein the CRISPR complex comprises the tracr mate sequence hybridized to the tracr sequence. In general, degree of complementarity is with reference to the optimal alignment of the tracr mate sequence and tracr sequence, along the length of the shorter of the two sequences. Optimal alignment may be determined by any suitable alignment algorithm, and may further account for secondary structures, such as self-complementarity within either the tracr sequence or tracr mate sequence. In some embodiments, the degree of complementarity between the tracr sequence and tracr mate sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and tracr mate sequence are contained within a single transcript, such that hybridization between the two produces a transcript having a secondary structure, such as a hairpin. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In a hairpin structure the portion of the sequence 5' of the final "N" and upstream of the loop corresponds to the tracr mate sequence, and the portion of the sequence 3' of the loop corresponds to the tracr sequence Further non-limiting examples of single polynucleotides comprising a guide sequence, a tracr mate sequence, and a tracr sequence are as follows (listed 5' to 3'), where "N" represents a base of a guide sequence, the first block of lower case letters represent the tracr mate sequence, and the second block of lower case letters represent the tracr sequence, and the final poly-T sequence represents the transcription terminator: (1) NNNNNNNNNNNNNNNNNNNNNgttttgtactctcaagatt-taGAAAtaaatcttgcagaagctacaaagataa ggcttcatgccgaaat-caacaccctgtcattttatggcagggtgttttcgttatttaaTTTTTT (SEQ ID NO: 13); (2) NNNNNNNNNNNNNNNNNN NNgttttgtactctcaGAAAtgcagaagctacaaagataaggcttcatgccg aaatcaacaccctgtcattttatggcagggtgttttcgttatttaaTTTTTT (SEQ ID NO: 14); (3) NNNNNNNNNNNNNNNNNNNN Ngttttgtactctcagaaatgcagaagctacaaagataaggcttcatgccg aaatcaacaccctgtcattttatggcagggtgtTTTTTT (SEQ ID NO: 15); (4) NNNNNNNNNNNNNNNNNNNNgttt-tagagctaGAAAtagcaagttaaaataaggctagtccgttatcaactt gaaaaagtggcaccgagtcggtgcTTTTTT (SEQ ID NO: 16); (5) NNNNNNNNNNNNNNNNNNNNgttt-tagagctaGAAATAGcaagttaaaataaggctagtccgttatcaac ttgaaaaagtgTTTTTTT (SEQ ID NO: 17); and (6) NNNNNNNNNNNNNNNNNNNNgttt-tagagctagAAATAGcaagttaaaataaggctagtccgttatcaTT TTTTTT (SEQ ID NO: 18). In some embodiments, sequences (1) to (3) are used in combination with Cas9 from *S. thermophilus* CRISPR1. In some embodiments, sequences (4) to (6) are used in combination with Cas9 from *S. pyogenes*. In some embodiments, the tracr sequence is a separate transcript from a transcript comprising the tracr mate sequence.

In some embodiments, candidate tracrRNA may be subsequently predicted by sequences that fulfill any or all of the following criteria: 1. sequence homology to direct repeats (motif search in Geneious with up to 18-bp mismatches); 2. presence of a predicted Rho-independent transcriptional terminator in direction of transcription; and 3. stable hairpin secondary structure between tracrRNA and direct repeat. In some embodiments, 2 of these criteria may be used, for instance 1 and 2, 2 and 3, or 1 and 3. In some embodiments, all 3 criteria may be used.

In some embodiments, chimeric synthetic guide RNAs (sgRNAs) designs may incorporate at least 12 bp of duplex structure between the direct repeat and tracrRNA.

For minimization of toxicity and off-target effect, it will be important to control the concentration of CRISPR enzyme mRNA and guide RNA delivered. Optimal concentrations of CRISPR enzyme mRNA and guide RNA can be determined by testing different concentrations in a cellular or non-human eukaryote animal model and using deep sequencing the analyze the extent of modification at potential off-target genomic loci. For example, for the guide sequence targeting 5'-GAGTCCGAGCAGAAGAAGAA-3' (SEQ ID NO: 19) in the EMX1 gene of the human genome, deep sequencing can be used to assess the level of modification at the following two off-target loci, 1: 5'-GAGTCCTAGCAGGAGAAGAA-3' (SEQ ID NO: 20) and 2: 5'-GAGTCTAAGCAGAAGAAGAA-3' (SEQ ID NO: 21). The concentration that gives the highest level of on-target modification while minimizing the level of off-target modification should be chosen for in vivo delivery. Alternatively, to minimize the level of toxicity and off-target effect, CRISPR enzyme nickase mRNA (for example *S. pyogenes* Cas9 with the D10A mutation) can be delivered with a pair of guide RNAs targeting a site of interest. The two guide RNAs need to be spaced as follows. Guide sequences and strategies to mimize toxicity and off-target effects can be as in WO 2014/093622 (PCT/US2013/074667).

The CRISPR system is derived advantageously from a type II CRISPR system. In some embodiments, one or more elements of a CRISPR system is derived from a particular organism comprising an endogenous CRISPR system, such as *Streptococcus pyogenes*. In preferred embodiments of the invention, the CRISPR system is a type II CRISPR system and the Cas enzyme is Cas9, which catalyzes DNA cleavage. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof.

In some embodiments, the unmodified CRISPR enzyme has DNA cleavage activity, such as Cas9. In some embodiments, the CRISPR enzyme directs cleavage of one or both strands at the location of a target sequence, such as within the target sequence and/or within the complement of the target sequence. In some embodiments, the CRISPR enzyme directs cleavage of one or both strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a CRISPR enzyme that is mutated to with respect to a corresponding wild-type enzyme such that the mutated CRISPR enzyme lacks the ability to cleave one or both strands of a target polynucleotide containing a target sequence. For example, an aspartate-to-alanine substitution (D10A) in the RuvC I catalytic domain of Cas9 from *S. pyogenes* converts Cas9 from a nuclease that cleaves both strands to a nickase (cleaves a single strand). Other examples of mutations that render Cas9 a nickase include, without limitation, H840A, N854A, and N863A. As a further example, two or more catalytic domains of Cas9 (RuvC I, RuvC II, and RuvC III or the HNH domain) may be mutated to produce a mutated Cas9 substantially lacking all DNA cleavage activity. In some embodiments, a D10A mutation is combined with one or more of H840A, N854A, or N863A mutations to produce a Cas9 enzyme substantially lacking all DNA cleavage activity. In some embodiments, a CRISPR enzyme is considered to substantially lack all DNA cleavage activity when the DNA cleavage activity of the mutated enzyme is about no more than 25%, 10%, 5%, 1%, 0.1%, 0.01%, or less of the DNA cleavage activity of the non-mutated form of the enzyme; an example can be when the DNA cleavage activity of the mutated form is nil or negligible as compared with the non-mutated form. Where the enzyme is not SpCas9, mutations may be made at any or all residues corresponding to positions 10, 762, 840, 854, 863 and/or 986 of SpCas9 (which may be ascertained for instance by standard sequence comparison tools). In particular, any or all of the following mutations are preferred in SpCas9: D10A, E762A, H840A, N854A, N863A and/or D986A; as well as conservative substitution for any of the replacement amino acids is also envisaged. The same (or conservative substitutions of these mutations) at corresponding positions in other Cas9s are also preferred. Particularly preferred are D10 and H840 in SpCas9. However, in other Cas9s, residues corresponding to SpCas9 D10 and H840 are also preferred. Orthologs of SpCas9 can be used in the practice of the invention. A Cas enzyme may be identified Cas9 as this can refer to the general class of enzymes that share homology to the biggest nuclease with multiple nuclease domains from the type II CRISPR system. Most preferably, the Cas9 enzyme is from, or is derived from, spCas9 (*S. pyogenes* Cas9) or saCas9 (*S. aureus* Cas9). StCas9" refers to wild type Cas9 from *S. thermophilus*, the protein sequence of which is given in the SwissProt database under accession number G3ECR1. Similarly, *S. pyogenes* Cas9 or spCas9 is included in SwissProt under accession number Q99ZW2. By derived, Applicants mean that the derived enzyme is largely based, in the sense of having a high degree of sequence homology with, a wildtype enzyme, but that it has been mutated (modified) in some way as described herein. It will be appreciated that the terms Cas and CRISPR enzyme are generally used herein interchangeably, unless otherwise apparent. As mentioned above, many of the residue numberings used herein refer to the Cas9 enzyme from the type II CRISPR locus in *Streptococcus pyogenes*. However, it will be appreciated that this invention includes many more Cas9s from other species of microbes, such as SpCas9, SaCa9, St1Cas9 and so forth. Enzymatic action by Cas9 derived from *Streptococcus pyogenes* or any closely related Cas9 generates double stranded breaks at target site sequences which hybridize to 20 nucleotides of the guide sequence and that have a protospacer-adjacent motif (PAM) sequence (examples include NGG/NRG or a PAM that can be determined as described herein) following the 20 nucleotides of the target sequence. CRISPR activity through Cas9 for site-specific DNA recognition and cleavage is defined by the guide sequence, the tracr sequence that hybridizes in part to the guide sequence and the PAM sequence. More aspects of the CRISPR system are described in Karginov and Hannon, The CRISPR system: small RNA-guided defence in bacteria and archaea, Mole Cell 2010, January 15; 37(1): 7. The type II CRISPR locus from *Streptococcus pyogenes* SF370, which contains a cluster of four genes Cas9, Cas1, Cas2, and Csn1, as well as two non-coding RNA elements, tracrRNA and a characteristic array of repetitive sequences (direct repeats) interspaced by short stretches of non-repetitive sequences (spacers, about 30 bp each). In this system, targeted DNA double-strand break (DSB) is generated in four sequential steps. First, two non-coding RNAs, the pre-crRNA array and tracrRNA, are transcribed from the CRISPR locus. Second, tracrRNA hybridizes to the direct repeats of pre-crRNA, which is then processed into mature crRNAs containing individual spacer sequences. Third, the mature crRNA:tracrRNA complex directs Cas9 to the DNA target consisting of the protospacer and the corresponding PAM via heteroduplex formation between the spacer region of the crRNA and the protospacer DNA. Finally, Cas9 mediates cleavage of target DNA upstream of PAM to create a DSB within the protospacer. A pre-crRNA array consisting of a single spacer flanked by two direct repeats (DRs) is also encompassed by the term "tracr-mate sequences"). In certain embodiments, Cas9 may be constitutively present or inducibly present or conditionally present or administered or delivered. Cas9 optimization may be used to enhance function or to develop new functions, one can generate chimeric Cas9 proteins. And Cas9 may be used as a generic DNA binding protein.

Typically, in the context of an endogenous CRISPR system, formation of a CRISPR complex (comprising a guide sequence hybridized to a target sequence and complexed with one or more Cas proteins) results in cleavage of one or both strands in or near (e.g. within 1, 2, 3, 4, 5, 6, 7, 8, 9, 10, 20, 50, or more base pairs from) the target sequence. Without wishing to be bound by theory, the tracr sequence, which may comprise or consist of all or a portion of a wild-type tracr sequence (e.g. about or more than about 20, 26, 32, 45, 48, 54, 63, 67, 85, or more nucleotides of a wild-type tracr sequence), may also form part of a CRISPR complex, such as by hybridization along at least a portion of the tracr sequence to all or a portion of a tracr mate sequence that is operably linked to the guide sequence.

An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667). Whilst this is preferred, it will be appreciated that other examples are possible and codon optimization for a host species other than human, or for codon optimization for specific organs is known. In some embodiments, an enzyme coding sequence encoding a CRISPR enzyme is codon optimized for expression in particular cells, such as eukaryotic cells. The eukaryotic cells may be those of or derived from a particular organism, such as a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a CRISPR enzyme correspond to the most frequently used codon for a particular amino acid.

In some embodiments, a vector encodes a CRISPR enzyme comprising one or more nuclear localization sequences (NLSs), such as about or more than about 1, 2, 3, 4, 5, 6, 7, 8, 9, 10, or more NLSs. In some embodiments, the CRISPR enzyme comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g. zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In a preferred embodiment of the invention, the CRISPR enzyme comprises at most 6 NLSs. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 22); the NLS from nucleoplasmin (e.g. the nucleoplasmin bipartite NLS with the sequence KRPAATKKAGQAKKKK (SEQ ID NO: 23)); the c-myc NLS having the amino acid sequence PAAKRVKLD (SEQ ID NO: 24) or RQRRNELKRSP (SEQ ID NO: 25); the hRNPA1 M9 NLS having the sequence NQSSNFGPMKGGNFG-GRSSGPYGGGGQYFAKPRNQGGY (SEQ ID NO: 26); the sequence RMRIZFKNKGKDTAELRRRRVEVS-VELRKAKKDEQILKRRNV (SEQ ID NO: 27) of the IBB domain from importin-alpha; the sequences VSRKRPRP (SEQ ID NO: 28) and PPKKARED (SEQ ID NO: 29) of the myoma T protein; the sequence PQPKKKPL (SEQ ID NO: 30) of human p53; the sequence SALIKKKKMAP (SEQ ID NO: 31) of mouse c-ab1 IV; the sequences DRLRR (SEQ ID NO: 32) and PKQKKRK (SEQ ID NO: 33) of the influenza virus NS1; the sequence RKLKKKIKKL (SEQ ID NO: 34) of the Hepatitis virus delta antigen; the sequence REKKKFLKRR (SEQ ID NO: 35) of the mouse Mx1 protein; the sequence KRKGDEVDGVDEVAKKKSKK (SEQ ID NO: 36) of the human poly(ADP-ribose) polymerase; and the sequence RKCLQAGMNLEARKTKK (SEQ ID NO: 37) of the steroid hormone receptors (human) glucocorticoid. In general, the one or more NLSs are of sufficient strength to drive accumulation of the CRISPR enzyme in a detectable amount in the nucleus of a eukaryotic cell. In general, strength of nuclear localization activity may derive from the number of NLSs in the CRISPR enzyme, the particular NLS(s) used, or a combination of these factors. Detection of accumulation in the nucleus may be performed by any suitable technique. For example, a detectable marker may be fused to the CRISPR enzyme, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or CRISPR enzyme activity), as compared to a control no exposed to the CRISPR enzyme or complex, or exposed to a CRISPR enzyme lacking the one or more NLSs.

Aspects of the invention relate to the expression of the gene product being decreased or a template polynucleotide being further introduced into the DNA molecule encoding the gene product or an intervening sequence being excised precisely by allowing the two 5' overhangs to reanneal and ligate or the activity or function of the gene product being altered or the expression of the gene product being increased. In an embodiment of the invention, the gene product is a protein. Only sgRNA pairs creating 5' overhangs with less than 8 bp overlap between the guide sequences (offset greater than −8 bp) were able to mediate detectable indel formation. Importantly, each guide used in these assays is able to efficiently induce indels when paired with wildtype Cas9, indicating that the relative positions of the guide pairs are the most important parameters in predicting double nicking activity. Since Cas9n and Cas9H840A nick opposite strands of DNA, substitution of Cas9n with Cas9H840A with a given sgRNA pair should have resulted in the inversion of the overhang type; but no indel formation is observed as with Cas9H840A indicating that Cas9H840A is a CRISPR enzyme substantially lacking all DNA cleavage activity (which is when the DNA cleavage activity of the mutated enzyme is about no more than 25%, 10%, 5%, 1%, 0.1%, 0.01%, or less of the DNA cleavage activity of the non-mutated form of the enzyme; whereby an example can be when the DNA cleavage activity of the mutated form is nil or negligible as compared with the non-mutated form, e.g., when no indel formation is observed as with Cas9H840A in the eukaryotic system in contrast to the biochemical or prokaryotic systems). Nonetheless, a pair of sgRNAs that will generate a 5' overhang with Cas9n should in principle generate the corresponding 3' overhang instead, and double nicking. Therefore, sgRNA pairs that lead to the generation of a 3' overhang with Cas9n can be used with another mutated Cas9 to generate a 5' overhang, and double nicking. Accordingly, in some embodiments, a recombination template is also provided. A recombination template may be a component of another vector as described herein, contained in a separate vector, or provided as a separate polynucleotide. In some embodiments, a recombination template is designed to serve as a template in homologous recombination, such as within or near a target sequence nicked or cleaved by a CRISPR enzyme as a part of a CRISPR complex. A template polynucleotide may be of any suitable length, such as about or more than about 10, 15, 20, 25, 50, 75, 100, 150, 200, 500, 1000, or more nucleotides in length. In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

In some embodiments, one or more vectors driving expression of one or more elements of a CRISPR system are introduced into a host cell such that expression of the elements of the CRISPR system direct formation of a CRISPR complex at one or more target sites. For example, a Cas enzyme, a guide sequence linked to a tracr-mate sequence, and a tracr sequence could each be operably linked to separate regulatory elements on separate vectors. Or, RNA(s) of the CRISPR System can be delivered to a transgenic Cas9 animal or mammal, e.g., an animal or mammal that constitutively or inducibly or conditionally expresses Cas9; or an animal or mammal that is otherwise expressing Cas9 or has cells containing Cas9, such as by way of prior administration thereto of a vector or vectors that code for and express in vivo Cas9. Alternatively, two or more of the elements expressed from the same or different regulatory elements, may be combined in a single vector, with one or more additional vectors providing any components of the CRISPR system not included in the first vector. CRISPR system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a CRISPR enzyme and one or more of the guide sequence, tracr mate sequence (optionally operably linked to the guide sequence), and a tracr sequence embedded within one or more intron sequences (e.g. each in a different intron, two or more in at least one intron, or all in a single intron). In some embodiments, the CRISPR enzyme, guide sequence, tracr mate sequence, and tracr sequence are operably linked to and expressed from the same promoter. Delivery vehicles, vectors, particles, nanoparticles, formulations and components thereof for expression of one or more elements of a CRISPR system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g. about or more than about 1, 2, 3, 4, 5, 6, 7, 8, 9, 10, or more insertion sites) are located upstream and/or downstream of one or more sequence elements of one or more vectors. In some embodiments, a vector comprises an insertion site upstream of a tracr mate sequence, and optionally downstream of a regulatory element operably linked to the tracr mate sequence, such that following insertion of a guide sequence into the insertion site and upon expression the guide sequence directs sequence-specific binding of a CRISPR complex to a target sequence in a eukaryotic cell. In some embodiments, a vector comprises two or more insertion sites, each insertion site being located between two tracr mate sequences so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target CRISPR activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell. In some embodiments, a vector comprises a regulatory element operably linked to an enzyme-coding sequence encoding a CRISPR enzyme, such as a Cas protein. CRISPR enzyme or CRISPR enzyme mRNA or CRISPR guide RNA or RNA(s) can be delivered separately; and advantageously at least one of these is delivered via a nanoparticle complex. CRISPR enzyme mRNA can be delivered prior to the guide RNA to give time for CRISPR enzyme to be expressed. CRISPR enzyme mRNA might be administered 1-12 hours (preferably around 2-6 hours) prior to the administration of guide RNA. Alternatively, CRISPR enzyme mRNA and guide RNA can be administered together. Advantageously, a second booster dose of guide RNA can be administered 1-12 hours (preferably around 2-6 hours) after the initial administration of CRISPR enzyme mRNA+guide RNA. Additional administrations of CRISPR enzyme mRNA and/or guide RNA might be useful to achieve the most efficient levels of genome modification.

In one aspect, the invention provides methods for using one or more elements of a CRISPR system. The CRISPR complex of the invention provides an effective means for modifying a target polynucleotide. The CRISPR complex of the invention has a wide variety of utility including modifying (e.g., deleting, inserting, translocating, inactivating, activating) a target polynucleotide in a multiplicity of cell types. As such the CRISPR complex of the invention has a broad spectrum of applications in, e.g., gene therapy, drug screening, disease diagnosis, and prognosis. An exemplary CRISPR complex comprises a CRISPR enzyme complexed with a guide sequence hybridized to a target sequence within the target polynucleotide. The guide sequence is linked to a tracr mate sequence, which in turn hybridizes to a tracr sequence. In one embodiment, this invention provides a method of cleaving a target polynucleotide. The method comprises modifying a target polynucleotide using a CRISPR complex that binds to the target polynucleotide and effect cleavage of said target polynucleotide. Typically, the CRISPR complex of the invention, when introduced into a cell, creates a break (e.g., a single or a double strand break) in the genome sequence. For example, the method can be used to cleave a disease gene in a cell. The break created by the CRISPR complex can be repaired by a repair processes such as the error prone non-homologous end joining (NHEJ) pathway or the high fidelity homology-directed repair (HDR). During these repair process, an exogenous polynucleotide template can be introduced into the genome sequence. In some methods, the HDR process is used modify genome sequence. For example, an exogenous polynucleotide template comprising a sequence to be integrated flanked by an upstream sequence and a downstream sequence is introduced into a cell. The upstream and downstream sequences share sequence similarity with either side of the site of integration in the chromosome. Where desired, a donor polynucleotide can be DNA, e.g., a DNA plasmid, a bacterial artificial chromosome (BAC), a yeast artificial chromosome (YAC), a viral vector, a linear piece of DNA, a PCR fragment, a naked nucleic acid, or a nucleic acid complexed with a delivery vehicle such as a liposome or poloxamer. The exogenous polynucleotide template comprises a sequence to be integrated (e.g., a mutated gene). The sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous polynucleotide template are selected to promote recombination between the chromosomal sequence of interest and the donor polynucleotide. The upstream sequence is a nucleic acid sequence that shares sequence similarity with the genome sequence upstream of the targeted site for integration. Similarly, the downstream sequence is a nucleic acid sequence that shares sequence similarity with the chromosomal sequence downstream of the targeted site of integration. The upstream and downstream sequences in the exogenous polynucleotide template can have 75%, 80%, 85%, 90%, 95%, or 100% sequence identity with the targeted genome sequence. Preferably, the upstream and downstream sequences in the exogenous polynucleotide template have about 95%, 96%, 97%, 98%, 99%, or 100% sequence identity with the targeted genome sequence. In some methods, the upstream and downstream sequences in the exogenous polynucleotide template have about 99% or 100% sequence identity with the targeted genome sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous polynucleotide template may further comprise a marker. Such a marker may make it easy to screen for targeted integrations. Examples of suitable markers include restriction sites, fluorescent proteins, or selectable markers. The exogenous polynucleotide template of the invention can be constructed using recombinant techniques (see, for example, Sambrook et al., 2001 and Ausubel et al., 1996). In a method for modifying a target polynucleotide by integrating an exogenous polynucleotide template, a double stranded break is introduced into the genome sequence by the CRISPR complex, the break is repaired via homologous recombination an exogenous polynucleotide template such that the template is integrated into the genome. The presence of a double-stranded break facilitates integration of the template. In other embodiments, this invention provides a method of modifying expression of a polynucleotide in a eukaryotic cell. The method comprises increasing or decreasing expression of a target polynucleotide by using a CRISPR complex that binds to the polynucleotide. In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein is not produced, or the sequence does not function as the wild-type sequence does. For example, a protein or microRNA coding sequence may be inactivated such that the protein or microRNA or pre-microRNA transcript is not produced. In some methods, a control sequence can be inactivated such that it no longer functions as a control sequence. As used herein, "control sequence" refers to any nucleic acid sequence that effects the transcription, translation, or accessibility of a nucleic acid sequence. Examples of a control sequence include, a promoter, a transcription terminator, and an enhancer are control sequences. The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Examples of target polynucleotides include a sequence associated with a signaling biochemical pathway, e.g., a signaling biochemical pathway-associated gene or polynucleotide. Examples of target polynucleotides include a disease associated gene or polynucleotide. A "disease-associated" gene or polynucleotide refers to any gene or polynucleotide which is yielding transcription or translation products at an abnormal level or in an abnormal form in cells derived from a disease-affected tissues compared with tissues or cells of a non disease control. It may be a gene that becomes expressed at an abnormally high level; it may be a gene that becomes expressed at an abnormally low level, where the altered expression correlates with the occurrence and/or progression of the disease. A disease-associated gene also refers to a gene possessing mutation(s) or genetic variation that is directly responsible or is in linkage disequilibrium with a gene(s) that is responsible for the etiology of a disease. The transcribed or translated products may be known or unknown, and may be at a normal or abnormal level. The target polynucleotide of a CRISPR complex can be any polynucleotide endogenous or exogenous to the eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA). Without wishing to be bound by theory, it is believed that the target sequence should be associated with a PAM (protospacer adjacent motif); that is, a short sequence recognized by the CRISPR complex. The precise sequence and length requirements for the PAM differ depending on the CRISPR enzyme used, but PAMs are typically 2-5 base pair sequences adjacent the protospacer (that is, the target sequence) Examples of PAM sequences are given in the examples section below, and the skilled person will be able to identify further PAM sequences for use with a given CRISPR enzyme. In some embodiments, the method comprises allowing a CRISPR complex to bind to the target polynucleotide to effect cleavage of said target polynucleotide thereby modifying the target polynucleotide, wherein the CRISPR complex comprises a CRISPR enzyme complexed with a guide sequence hybridized to a target sequence within said target polynucleotide, wherein said guide sequence is linked to a tracr mate sequence which in turn hybridizes to a tracr sequence. In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR enzyme complexed with a guide sequence hybridized to a target sequence within said polynucleotide, wherein said guide sequence is linked to a tracr mate sequence which in turn hybridizes to a tracr sequence. Similar considerations and conditions apply as above for methods of modifying a target polynucleotide. In fact, these sampling, culturing and re-introduction options apply across the aspects of the present invention. In one aspect, the invention provides for methods of modifying a target polynucleotide in a eukaryotic cell, which may be in vivo, ex vivo or in vitro. In some embodiments, the method comprises sampling a cell or population of cells from a human or non-human animal, and modifying the cell or cells. Culturing may occur at any stage ex vivo. The cell or cells may even be re-introduced into the non-human animal or plant. For re-introduced cells it is particularly preferred that the cells are stem cells.

Indeed, in any aspect of the invention, the CRISPR complex may comprise a CRISPR enzyme complexed with a guide sequence hybridized to a target sequence, wherein said guide sequence may be linked to a tracr mate sequence which in turn may hybridize to a tracr sequence.

The invention relates to the engineering and optimization of systems, methods and compositions used for the control of gene expression involving sequence targeting, such as genome perturbation or gene-editing, that relate to the CRISPR-Cas system and components thereof. In advantageous embodiments, the Cas enzyme is Cas9. An advantage of the present methods is that the CRISPR system minimizes or avoids off-target binding and its resulting side effects. This is achieved using systems arranged to have a high degree of sequence specificity for the target DNA.

Cas9

Cas9 optimization may be used to enhance function or to develop new functions, one can generate chimeric Cas9 proteins, as demonstrated in the Examples. Chimeric Cas9 proteins can be made by combining fragments from different Cas9 homologs. For example, two example chimeric Cas9 proteins from the Cas9s described herein. For example, Applicants fused the N-term of St1Cas9 (fragment from this protein is in bold) with C-term of SpCas9. The benefit of making chimeric Cas9s include any or all of: reduced toxicity; improved expression in eukaryotic cells; enhanced specificity; reduced molecular weight of protein, for example, making the protein smaller by combining the smallest domains from different Cas9 homologs; and/or altering the PAM sequence requirement.

The Cas9 may be used as a generic DNA binding protein as demonstrated in the Examples. Applicants used Cas9 as a generic DNA binding protein by mutating the two catalytic domains (D10 and H840) responsible for cleaving both strands of the DNA target. In order to upregulate gene transcription at a target locus Applicants fused a transcriptional activation domain (VP64) to Cas9. Other transcriptional activation domains are known. As shown in the Examples transcriptional activation is possible as well as gene repression using a Cas9 repressor (DNA-binding domain) that binds to the target gene sequence, thus repressing its activity.

Cas9 and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed.

The viral vectors can be injected into the tissue of interest. For cell-type specific genome modification, the expression of Cas9 can be driven by a cell-type specific promoter. For example, liver-specific expression might use the Albumin promoter whereas neuron-specific expression (for viruses which may be latent in the brain) might use the Synapsin I promoter.

Transgenic Animals and Plants

Figure 25A:
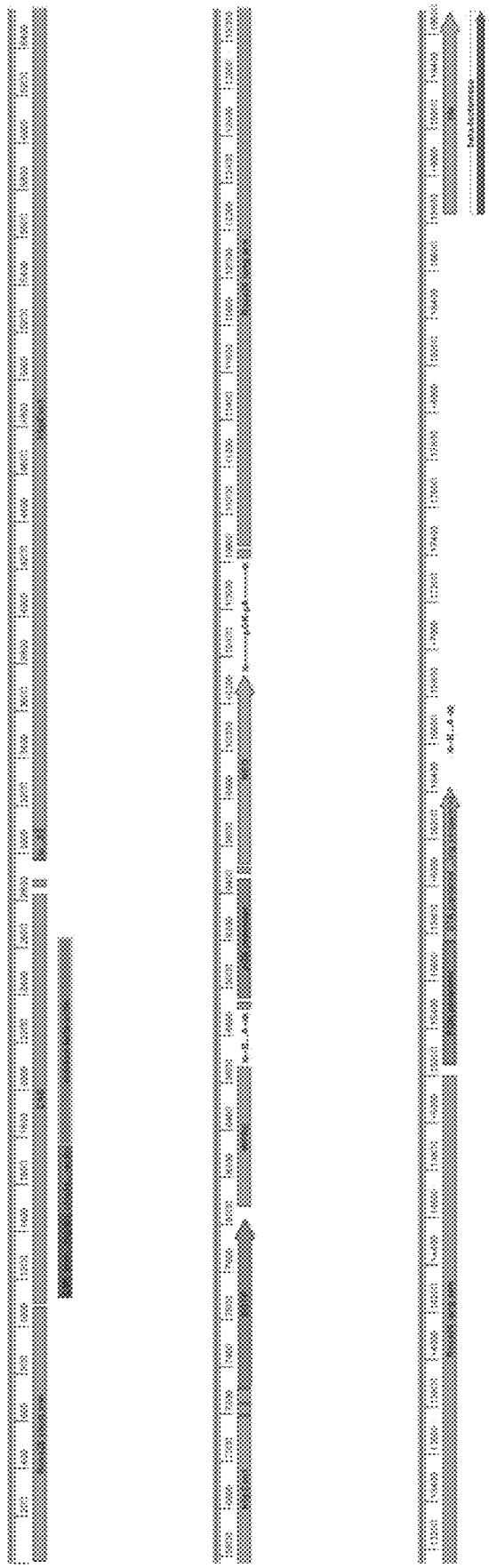
FIG. 25A shows the Conditional Cas9, Rosa26 targeting vector map.
Figure 25B:
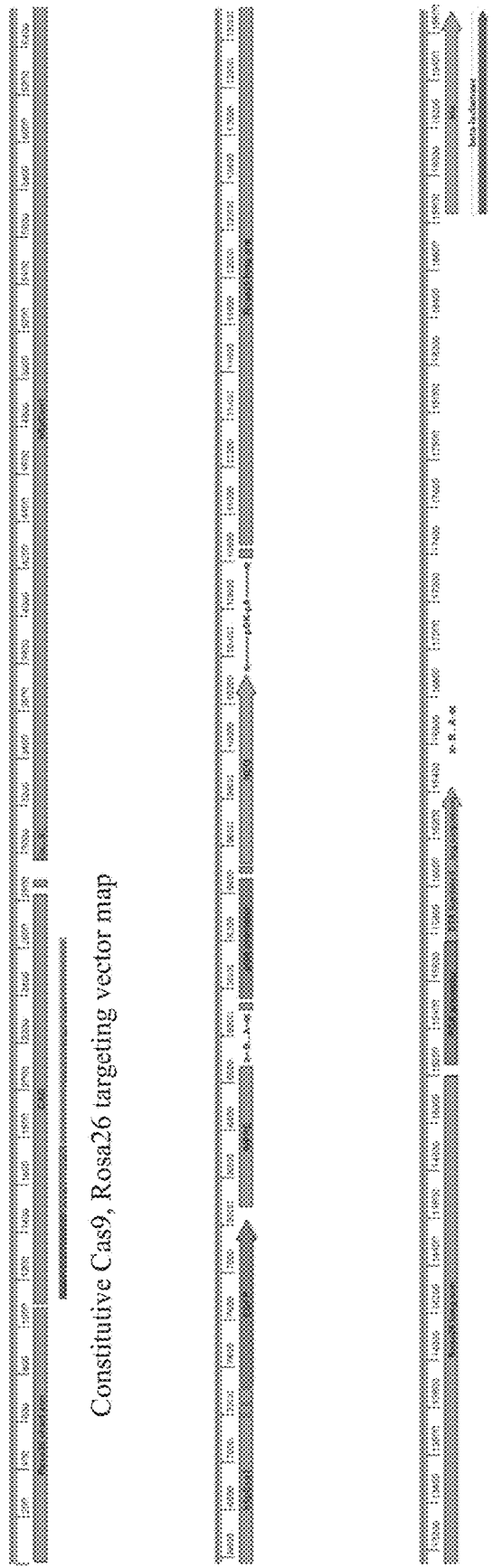
FIG. 25B shows the Constitutive Cas9, Rosa26 targeting vector map.
Figure 26:
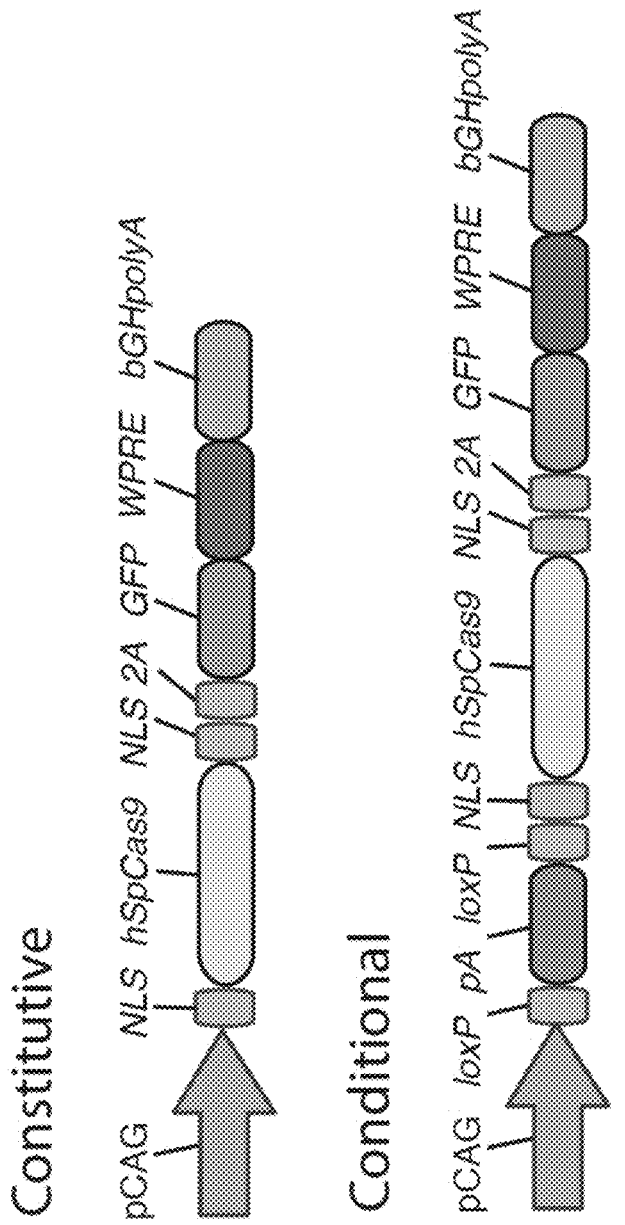
FIG. 26 shows a schematic of the important elements in the Constitutive and Conditional Cas9 constructs.

Transgenic animals are also provided. Preferred examples include animals comprising Cas9, in terms of polynucleotides encoding Cas9 or the protein itself. Mice, rats and rabbits are preferred. To generate transgenic mice with the constructs, as exemplified herein one may inject pure, linear DNA into the pronucleus of a zygote from a pseudo pregnant female, e.g. a CB56 female. Founders may then be identified, genotyped, and backcrossed to CB57 mice. The constructs may then be cloned and optionally verified, for instance by Sanger sequencing. Knock outs are envisaged where for instance one or more genes are knocked out in a model. However, are knockins are also envisaged (alone or in combination). An example knockin Cas9 mouse was generated and this is exemplified, but Cas9 knockins are preferred. To generate a Cas9 knock in mice one may target the same constitutive and conditional constructs to the Rosa26 locus, as described herein (FIGS. 25A-B and 26). Methods of US Patent Publication Nos. 20120017290 and 20110265198 assigned to Sangamo BioSciences, Inc. directed to targeting the Rosa locus may be modified to utilize the CRISPR Cas system of the present invention. In another embodiment, the methods of US Patent Publication No. 20130236946 assigned to Cellectis directed to targeting the Rosa locus may also be modified to utilize the CRISPR Cas system of the present invention.

Utility of the conditional Cas9 mouse: Applicants have shown in 293 cells that the Cas9 conditional expression construct can be activated by co-expression with Cre. Applicants also show that the correctly targeted R1 mESCs can have active Cas9 when Cre is expressed. Because Cas9 is followed by the P2A peptide cleavage sequence and then EGFP Applicants identify successful expression by observing EGFP. Applicants have shown Cas9 activation in mESCs. This same concept is what makes the conditional Cas9 mouse so useful. Applicants may cross their conditional Cas9 mouse with a mouse that ubiquitously expresses Cre (ACTB-Cre line) and may arrive at a mouse that expresses Cas9 in every cell. It should only take the delivery of chimeric RNA to induce genome editing in embryonic or adult mice. Interestingly, if the conditional Cas9 mouse is crossed with a mouse expressing Cre under a tissue specific promoter, there should only be Cas9 in the tissues that also express Cre. This approach may be used to edit the genome in only precise tissues by delivering chimeric RNA to the same tissue.

Delivery Generally

Vector delivery, e.g., plasmid, viral delivery: The CRISPR enzyme, for instance a Cas9, and/or any of the present RNAs, for instance a guide RNA, can be delivered using any suitable vector, e.g., plasmid or viral vectors, such as adeno associated virus (AAV), lentivirus, adenovirus or other viral vector types, or combinations thereof. Cas9 and one or more guide RNAs can be packaged into one or more vectors, e.g., plasmid or viral vectors. In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1 \times 10^5$ particles (also referred to as particle units, pu) of adenoviral vector. In an embodiment herein, the dose preferably is at least about $1 \times 10^6$ particles (for example, about $1 \times 10^6$-$1 \times 10^{12}$ particles), more preferably at least about $1 \times 10^7$ particles, more preferably at least about $1 \times 10^8$ particles (e.g., about $1 \times 10^8$-$1 \times 10^{11}$ particles or about $1 \times 10^8$-$1 \times 10^{12}$ particles), and most preferably at least about $1 \times 10^0$ particles (e.g., about $1 \times 10^9$-$1 \times 10^{10}$ particles or about $1 \times 10^9$-$1 \times 10^{12}$ particles), or even at least about $1 \times 10^{10}$ particles (e.g., about $1 \times 10^{10}$-$1 \times 10^{12}$ particles) of the adenoviral vector. Alternatively, the dose comprises no more than about $1 \times 10^{14}$ particles, preferably no more than about $1 \times 10^{13}$ particles, even more preferably no more than about $1 \times 10^{12}$ particles, even more preferably no more than about $1 \times 10^{11}$ particles, and most preferably no more than about $1 \times 10^{10}$ particles (e.g., no more than about $1 \times 10^9$ articles). Thus, the dose may contain a single dose of adenoviral vector with, for example, about $1 \times 10^6$ particle units (pu), about $2 \times 10^6$ pu, about $4 \times 10^6$ pu, about $1 \times 10^7$ pu, about $2 \times 10^7$ pu, about $4 \times 10^7$ pu, about $1 \times 10^8$ pu, about $2 \times 10^8$ pu, about $4 \times 10^8$ pu, about $1 \times 10^9$ pu, about $2 \times 10^9$ pu, about $4 \times 10^9$ pu, about $1 \times 10^{10}$ pu, about $2 \times 10^{10}$ pu, about $4 \times 10^{10}$ pu, about $1 \times 10^{11}$ pu, about $2 \times 10^{11}$ pu, about $4 \times 10^{11}$ pu, about $1 \times 10^{12}$ pu, about $2 \times 10^{12}$ pu, or about $4 \times 10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1 \times 10^{10}$ to about $1 \times 10^{10}$ functional AAV/ml solution. The dosage may be adjusted to balance the therapeutic benefit against any side effects. In an embodiment herein, the AAV dose is generally in the range of concentrations of from about $1 \times 10^5$ to $1 \times 10^{50}$ genomes AAV, from about $1 \times 10^8$ to $1 \times 10^{20}$ genomes AAV, from about $1 \times 10^{10}$ to about $1 \times 10^{16}$ genomes, or about $1 \times 10^{11}$ to about $1 \times 10^{16}$ genomes AAV. A human dosage may be about $1 \times 10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 g to about 10 g per 70 kg individual. Plasmids of the invention will generally comprise (i) a promoter; (ii) a sequence encoding a CRISPR enzyme, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Indeed, RNA delivery is a useful method of in vivo delivery. It is possible to deliver Cas9 and gRNA (and, for instance, HR repair template) into cells using liposomes or nanoparticles. Thus delivery of the CRISPR enzyme, such as a Cas9 and/or delivery of the RNAs of the invention may be in RNA form and via microvesicles, liposomes or nanoparticles. For example, Cas9 mRNA and gRNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E (α-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free Tocsi-BACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to α-tocopherol and co-administered with HDL targeted to the brain may be contemplated for humans in the present invention, for example, about 3 nmol to about 3 µmol of CRISPR Cas targeted to the brain may be contemplated. Zou et al. ((HUMAN GENE THERAPY 22:465-475 (April 2011)) describes a method of lentiviral-mediated delivery of short-hairpin RNAs targeting PKC7 for in vivo gene silencing in the spinal cord of rats. Zou et al. administered about 10 µl of a recombinant lentivirus having a titer of $1\times10^9$ transducing units (TU)/ml by an intrathecal catheter. A similar dosage of CRISPR Cas expressed in a lentiviral vector targeted to the brain may be contemplated for humans in the present invention, for example, about 10-50 ml of CRISPR Cas targeted to the brain in a lentivirus having a titer of $1\times10^9$ transducing units (TU)/ml may be contemplated.

In terms of local delivery to the brain, this can be achieved in various ways. For instance, material can be delivered intrastriatally e.g. by injection. Injection can be performed stereotactically via a craniotomy.

Enhancing NHEJ or HR efficiency is also helpful for delivery. It is preferred that NHEJ efficiency is enhanced by co-expressing end-processing enzymes such as Trex2 (Dumitrache et al. Genetics. 2011 August; 188(4): 787-797). It is preferred that HR efficiency is increased by transiently inhibiting NHEJ machineries such as Ku70 and Ku86. HR efficiency can also be increased by co-expressing prokaryotic or eukaryotic homologous recombination enzymes such as RecBCD, RecA.

Packaging and Promoters Generally

Ways to package Cas9 coding nucleic acid molecules, e.g., DNA, into vectors, e.g., viral vectors, to mediate genome modification in vivo include:

To achieve NHEJ-mediated gene knockout:
Single virus vector:
Vector containing two or more expression cassettes:
Promoter-Cas9 coding nucleic acid molecule-terminator
Promoter-gRNA1-terminator
Promoter-gRNA2-terminator
Promoter-gRNA(N)-terminator (up to size limit of vector)
Double virus vector:
Vector 1 containing one expression cassette for driving the expression of Cas9
Promoter-Cas9 coding nucleic acid molecule-terminator
Vector 2 containing one more expression cassettes for driving the expression of one or more guideRNAs
Promoter-gRNA1-terminator
Promoter-gRNA(N)-terminator (up to size limit of vector)
To mediate homology-directed repair.
In addition to the single and double virus vector approaches described above, an additional vector is used to deliver a homology-direct repair template.

The promoter used to drive Cas9 coding nucleic acid molecule expression can include:

AAV ITR can serve as a promoter: this is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of Cas9.

For ubiquitous expression, can use promoters: CMV, CAG, CBh, PGK, SV40, Ferritin heavy or light chains, etc.

For brain or other CNS expression, can use promoters: SynapsinI for all neurons, CaMKIIalpha for excitatory neurons, GAD67 or GAD65 or VGAT for GABAergic neurons, etc.

For liver expression, can use Albumin promoter.
For lung expression, can use SP-B.
For endothelial cells, can use ICAM.
For hematopoietic cells can use IFNbeta or CD45.
For Osteoblasts can use OG-2.
The promoter used to drive guide RNA can include:
Pol III promoters such as U6 or H1
Use of Pol II promoter and intronic cassettes to express gRNA
Adeno Associated Virus (AAV)

Cas9 and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of Cas9 can be driven by a cell-type specific promoter. For example, liver-specific expression might use the Albumin promoter and neuron-specific expression (e.g. for targeting CNS disorders) might use the Synapsin I promoter.

In terms of in vivo delivery, AAV is advantageous over other viral vectors for a couple of reasons:
- Low toxicity (this may be due to the purification method not requiring ultra centrifugation of cell particles that can activate the immune response)
- Low probability of causing insertional mutagenesis because it doesn't integrate into the host genome.

AAV has a packaging limit of 4.5 or 4.75 Kb. This means that Cas9 as well as a promoter and transcription terminator have to be all fit into the same viral vector. Constructs larger than 4.5 or 4.75 Kb will lead to significantly reduced virus production. SpCas9 is quite large, the gene itself is over 4.1 Kb, which makes it difficult for packing into AAV. Therefore embodiments of the invention include utilizing homologs of Cas9 that are shorter. For example:

TABLE 1

| Species | Cas9 Size |
|---|---|
| Corynebacter diphtheriae | 3252 |
| Eubacterium ventriosum | 3321 |
| Streptococcus pasteurianus | 3390 |
| Lactobacillus farciminis | 3378 |
| Sphaerochaeta globus | 3537 |
| Azospirillum B510 | 3504 |
| Gluconacetobacter diazotrophicus | 3150 |
| Neisseria cinerea | 3246 |
| Roseburia intestinalis | 3420 |
| Parvibaculum lavamentivorans | 3111 |
| Staphylococcus aureus | 3159 |
| Nitratifractor salsuginis DSM 16511 | 3396 |
| Campylobacter lari CF89-12 | 3009 |
| Streptococcus thermophilus LMD-9 | 3396 |

These species are therefore, in general, preferred Cas9 species.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

TABLE 2

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentivirus

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 μg of lentiviral transfer plasmid (pCasES10) and the following packaging plasmids: 5 μg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4C. They were then aliquotted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the CRISPR-Cas system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the CRISPR-Cas system of the present invention. A minimum of $2.5 \times 10^6$ CD34+ cells per kilogram patient weight may be collected and prestimulated for 16 to 20 hours in X-VIVO 15 medium (Lonza) containing 2 μmol/L-glutamine, stem cell factor (100 ng/ml), Flt-3 ligand (Flt-3L) (100 ng/ml), and thrombopoietin (10 ng/ml) (CellGenix) at a density of $2 \times 10^6$ cells/ml. Prestimulated cells may be transduced with lentiviral at a multiplicity of infection of 5 for 16 to 24 hours in 75-cm² tissue culture flasks coated with fibronectin (25 mg/cm²) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos.

US20110293571; US20110293571, US20040013648, US20070025970, US20090111106 and U.S. Pat. No. 7,259, 015.

RNA Delivery

RNA delivery: The CRISPR enzyme, for instance a Cas9, and/or any of the present RNAs, for instance a guide RNA, can also be delivered in the form of RNA. Cas9 mRNA can be generated using in vitro transcription. For example, Cas9 mRNA can be synthesized using a PCR cassette containing the following elements: T7_promoter-kozak sequence (GC-CACC)-Cas9-3' UTR from beta globin-polyA tail (a string of 120 or more adenines). The cassette can be used for transcription by T7 polymerase. Guide RNAs can also be transcribed using in vitro transcription from a cassette containing T7_promoter-GG-guide RNA sequence.

To enhance expression and reduce possible toxicity, the CRISPR enzyme-coding sequence and/or the guide RNA can be modified to include one or more modified nucleoside e.g. using pseudo-U or 5-Methyl-C.

mRNA delivery methods are especially promising for liver delivery currently.

Much clinical work on RNA delivery has focused on RNAi or antisense, but these systems can be adapted for delivery of RNA for implementing the present invention. References below to RNAi etc. should be read accordingly.

Nanoparticles

CRISPR enzyme mRNA and guide RNA may be delivered simultaneously using nanoparticles or lipid envelopes. For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured nanoparticles with a poly(O-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, nanoparticles based on self assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

In one embodiment, nanoparticles that can deliver RNA to a cancer cell to stop tumor growth developed by Dan Anderson's lab at MIT may be used/and or adapted to the CRISPR Cas system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13;13(3): 1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93. US patent application 20110293703 relates to lipidoid compounds are also particularly useful in the administration of polynucleotides, which may be applied to deliver the CRISPR Cas system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The minoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition. US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30.-100 C., preferably at approximately 50.-90 C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated. US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell. US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the CRISPR Cas system of the present invention.

In another embodiment, lipid nanoparticles (LNPs) are contemplated. In particular, an antitransthyretin small interfering RNA encapsulated in lipid nanoparticles (see, e.g., Coelho et al., N Engl J Med 2013; 369:819-29) may be applied to the CRISPR Cas system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated. LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding CRISPR Cas to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease. However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, Dec. 2011). Negatively charged polymers such asiRNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, Dec. 2011). A dosage of 1 μg/ml levels may be contemplated, especially for a formulation containing DLinKC2-DMA.

Preparation of LNPs and CRISPR Cas encapsulation may be used/and or adapted from Rosin et al, Molecular Therapy, vol. 19, no. 12, pages 1286-2200, Dec. 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(o-methoxy-poly(ethylene glycol)2000) carbamoyl]-1,2-dimyristyloxlpropyl-3-amine (PEG-C-DOMG) may be provided by Tekmira Pharmaceuticals (Vancouver, Canada) or synthesized. Cholesterol may be purchased from Sigma (St Louis, MO). The specific CRISPR Cas RNA may be encapsulated in LNPs containing DLinDAP, DLinDMA, DLinK-DMA, and DLinKC2-DMA (cationic lipid:DSPC: CHOL: PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Nanoparticle size distribution may be determined by dynamic light scattering using a NICOMP 370 particle sizer, the vesicle/intensity modes, and Gaussian fitting (Nicomp Particle Sizing, Santa Barbara, CA). The particle size for all three LNP systems may be ~70 nm in diameter. siRNA encapsulation efficiency may be determined by removal of free siRNA using VivaPureD MiniH columns (Sartorius Stedim Biotech) from samples collected before and after dialysis. The encapsulated RNA may be extracted from the eluted nanoparticles and quantified at 260 nm. siRNA to lipid ratio was determined by measurement of cholesterol content in vesicles using the Cholesterol E enzymatic assay from Wako Chemicals USA (Richmond, VA). Preparation of large LNPs may be used/and or adapted from Rosin et al, Molecular Therapy, vol. 19, no. 12, pages 1286-2200, Dec. 2011. A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/l, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano Z S, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at an siRNA to total lipid ratio of approximately 1:10 (wt:wt), followed by incubation for 30 minutes at 37° C. to form loaded LNPs. The mixture may be subsequently dialyzed overnight in PBS and filtered with a 0.45-μm syringe filter.

Spherical Nucleic Acid (SNA™) constructs and other nanoparticles (particularly gold nanoparticles) are also contemplate as a means to delivery CRISPR/Cas system to intended targets. Significant data show that AuraSense Therapeutics' Spherical Nucleic Acid (SNA™) constructs, based upon nucleic acid-functionalized gold nanoparticles, are superior to alternative platforms based on multiple key success factors, such as: High in vivo stability: Due to their dense loading, a majority of cargo (DNA or siRNA) remains bound to the constructs inside cells, conferring nucleic acid stability and resistance to enzymatic degradation. Deliverability: For all cell types studied (e.g., neurons, tumor cell lines, etc.) the constructs demonstrate a transfection efficiency of 99% with no need for carriers or transfection agents. Therapeutic targeting: The unique target binding affinity and specificity of the constructs allow exquisite specificity for matched target sequences (i.e., limited off-target effects). Superior efficacy: The constructs significantly outperform leading conventional transfection reagents (Lipofectamine 2000 and Cytofectin). Low toxicity: The constructs can enter a variety of cultured cells, primary cells, and tissues with no apparent toxicity. No significant immune response: The constructs elicit minimal changes in global gene expression as measured by whole-genome microarray studies and cytokine-specific protein assays. Chemical tailorability: Any number of single or combinatorial agents (e.g., proteins, peptides, small molecules) can be used to tailor the surface of the constructs. This platform for nucleic acid-based therapeutics may be applicable to numerous disease states, including inflammation and infectious disease, cancer, skin disorders and cardiovascular disease. Citable literature includes: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci. USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling nanoparticles with siRNA may be constructed with polyethyleneimine (PEI) that is PEGylated with an Arg-Gly-Asp (RGD) peptide ligand attached at the distal end of the polyethylene glycol (PEG), for example, as a means to target tumor neovasculature expressing integrins and used to deliver siRNA inhibiting vascular endothelial growth factor receptor-2 (VEGF R2) expression and thereby tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of CRISPR Cas is envisioned for delivery in the self-assembling nanoparticles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclodo-decane-1,4,7,10-tetraacetic acid mono(N-hydroxysuccinimide ester) (DOTA-NHSester) was ordered from Macrocyclics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA nanoparticles may be formed by using cyclodextrin-containing polycations. Typically, nanoparticles were formed in water at a charge ratio of 3 (+/−) and an siRNA concentration of 0.5 g/liter. One percent of the adamantane-PEG molecules on the surface of the targeted nanoparticles were modified with Tf (adamantane-PEG-Tf). The nanoparticles were suspended in a 5% (wt/vol) glucose carrier solution for injection.

Davis et al. (Nature, Vol 464, 15 Apr. 2010) conducts a siRNA clinical trial that uses a targeted nanoparticle-delivery system (clinical trial registration number NCT00689065). Patients with solid cancers refractory to standard-of-care therapies are administered doses of targeted nanoparticles on days 1, 3, 8 and 10 of a 21-day cycle by a 30-min intravenous infusion. The nanoparticles consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+5). The TFR has long been known to be upregulated in malignant cells, and RRM2 is an established anti-cancer target. These nanoparticles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumours, Davis et al. investigated biopsies from three patients from three different dosing cohorts; patients A, B and C, all of whom had metastatic melanoma and received CALAA-01 doses of 18, 24 and 30 mg m$^{-2}$ siRNA, respectively. Similar doses may also be contemplated for the CRISPR Cas system of the present invention. The delivery of the invention may be achieved with nanoparticles containing a linear, cyclodextrin-based polymer (CDP), a human transferrin protein (TF) targeting ligand displayed on the exterior of the nanoparticle to engage TF receptors (TFR) on the surface of the cancer cells and/or a hydrophilic polymer (for example, polyethylene glycol (PEG) used to promote nanoparticle stability in biological fluids).

Exosomes

Exosomes are endogenous nano-vesicles that transport RNAs and proteins which can deliver short interfering (si)RNA to the brain and other target organs. To reduce immunogenicity, Alvarez-Erviti et al. (2011, Nat Biotechnol 29: 341) used self-derived dendritic cells for exosome production. Targeting was achieved by engineering the dendritic cells to express Lamp2b, an exosomal membrane protein, fused to the neuron-specific RVG peptide3. Purified exosomes were loaded with exogenous siRNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease. To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by nanoparticle tracking analysis (NTA) and electron microscopy. Alvarez-Erviti et al. obtained 6-12 μg of exosomes (measured based on protein concentration) per $10^6$ cells. Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled siRNA was used for the empirical optimization of the electroporation protocol. The amount of encapsulated siRNA was assayed after ultracentrifugation and lysis of exosomes. Electroporation at 400 V and 125 μF resulted in the greatest retention of siRNA and was used for all subsequent experiments. Alvarez-Erviti et al. administered 150 μg of each BACE1 siRNA encapsulated in 150 μg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG pep tide conjugated to 9 D-arginines that electrostatically binds to the siRNA. Cortical tissue samples were analyzed 3 d after administration and a significant protein knockdown (45%, P<0.05, versus 62%, P<0.01) in both siRNA-RVG-9R-treated and siRNARVG exosome-treated mice was observed, resulting from a significant decrease in BACE1 mRNA levels (66% [+ or −]15%, P<0.001 and 61% [+ or −]13% respectively, P<0.01). Moreover, Applicants demonstrated a significant decrease (55%, P<0.05) in the total [beta]-amyloid 1-42 levels, a main component of the amyloid plaques in Alzheimer's pathology, in the RVG-exosome-treated animals. The decrease observed was greater than the β-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA. Finally, Alvarez-Erviti et al. investigated whether siRNA-RVG exosomes induced immune responses in vivo by assessing IL-6, IP-10, TNFα and IFN-α serum concentrations. Following siRNA-RVG exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the CRISPR-Cas system of the present invention to therapeutic targets, especially neurodegenerative diseases. A dosage of about 100 to 1000 mg of CRISPR Cas encapsulated in about 100 to 1000 mg of RVG exosomes may be contemplated for the present invention.

El-Andaloussi et al. (Nature Protocols 7,2112-2126 (2012)) discloses how exosomes derived from cultured cells can be harnessed for delivery of siRNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading siRNA into exosomes. Finally, El-Andaloussi et al. outline how to use exosomes to efficiently deliver siRNA in vitro and in vivo in mouse brain. Examples of anticipated results in which exosome-mediated siRNA delivery is evaluated by functional assays and imaging are also provided. The entire protocol takes ~3 weeks. Delivery or administration according to the invention may be performed using exosomes produced from self-derived dendritic cells.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property might be useful in gene therapy.

Exosomes from plasma are prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of CRISPR Cas into exosomes may be conducted similarly to siRNA. The exosomes may be co-cultured with monocytes and lymphocytes isolated from the peripheral blood of healthy donors. Therefore, it may be contemplated that exosomes containing CRISPR Cas may be introduced to monocytes and lymphocytes of and autologously reintroduced into a human. Accordingly, delivery or administration according to the invention may beperformed using plasma exosomes.

Liposomes'

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, non-toxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review). Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review). Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review). A liposome formulation may be mainly comprised of natural phospholipids and lipids such as 1,2-distearoryl-sn-glycero-3-phosphatidyl choline (DSPC), sphingomyelin, egg phosphatidylcholines and monosialo-ganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review). In a particularly advantageous embodiment, Trojan Horse liposomes (also known as Molecular Trojan Horses) are desirable and protocols may be found at cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Utilizing Trojan Horse Liposomes to deliver the CRISPR family of nucleases to the brain via an intravascular injection, can allow whole brain transgenic animals without the need for embryonic manipulation. About 1-5 g of DNA or RNA may be contemplated for in vivo administration in liposomes.

In another embodiment, the CRISPR Cas system may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific CRISPR Cas targeted in a SNALP are contemplated. The daily treatment may be over about three days and then weekly for about five weeks. In another embodiment, a specific CRISPR Cas encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(wmethoxypoly(ethylene glycol) 2000) carbamoyl]-1,2-dimyristyloxy-propylamine (PEG-C-DMA), 1,2-dilinoleyloxy-N,N-dimethyl-3-amino-propane (DLinDMA), 1,2-distearoyl-sn-glycero-3-phospho-choline (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol)

2000)carbamoyl]-1,2-dimyrestyloxypropylamine, and cationic 1,2-dilinoleyloxy-3-N,N dimethylaminopropane (see, e.g., Geisbert et al., Lancet 2010; 375: 1896-905). A dosage of about 2 mg/kg total CRISPR Cas per dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids—an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic siRNA during particle formation. When positively charged under increasingly acidic endosomal conditions, the ionizable lipid also mediates the fusion of SNALP with the endosomal membrane enabling release of siRNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALPsiRNA formulations. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial. Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC)—both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid were solubilized in ethanol at a molar ratio of 40:10:40:10, respectively (see, Semple et al., Nature Niotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na2HPO4, 1 mM KH2PO4, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 μm filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method may be extrapolated to the CRISPR Cas system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate CRISPR Cas similar to SiRNA (see, e.g., Jayaraman, Angew. Chem. Int. Ed. 2012, 51, 8529-8533). A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11_0.04 (n=56), the particles may be extruded up to three times through 80 nm membranes prior to adding the CRISPR Cas RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity. Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the CRISPR Cas system of the present invention to form lipid nanoparticles (LNPs). Lipids include, but are not limited to, DLin-KC2-DMA4, C12-200 and colipids disteroylphosphatidyl choline, cholesterol, and PEG-DMG may be formulated with CRISPR Cas instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid nanoparticles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 0.1766035; 1519714; 1781593 and 1664316), all of which may be used and/or adapted to the present invention.

The CRISPR Cas system may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid: fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36. US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart. Dendrimers are synthetic 3-dimensional macromolecules that are prepared in a step-wise fashion from simple branched monomer units, the nature and functionality of which can be easily controlled and varied. Dendrimers are synthesised from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or $N—P(O_2)S$ as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied. US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered."

Supercharged Proteins

Supercharged proteins are a class of engineered or naturally occurring proteins with unusually high positive or negative net theoretical charge. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, siRNA, or other proteins, can enable the functional delivery of these macromolecules into mammalian cells both in vitro and in vivo. David Liu's lab reported the creation and characterization of supercharged proteins in 2007 (Lawrence et al., 2007, Journal of the American Chemical Society 129, 10110-10112). The nonviral delivery of siRNA and plasmid DNA into mammalian cells are valuable both for research and therapeutic applications (Akinc et al., 2010, Nat. Biotech. 26, 561-569). Purified+36 GFP protein (or other superpositively charged protein) is mixed with siRNAs in the appropriate serum-free media and allowed to complex prior addition to cells. Inclusion of serum at this stage inhibits formation of the supercharged protein-siRNA complexes and reduces the effectiveness of the treatment. The following protocol has been found to be effective for a variety of cell lines (McNaughton et al., 2009, Proc. Natl. Acad. Sci. USA 106, 6111-6116). However, pilot experiments varying the dose of protein and RNA, e.g., siRNA or CRISPR RNA can be performed to optimize the procedure for specific cell lines.

(1) One day before treatment, plate 1×10⁵ cells per well in a 48-well plate.
(2) On the day of treatment, dilute purified+36 GFP protein in serum free media to a final concentration 200 nM. Add siRNA or CRISPR RNA to a final concentration of 50 nM. Vortex to mix and incubate at room temperature for 10 min.
(3) During incubation, aspirate media from cells and wash once with PBS.
(4) Following incubation of +36 GFP and siRNA or CRISPR RNA, add the protein-siRNA or CRISPR RNA complexes to cells.
(5) Incubate cells with complexes at 37 C for 4 h.
(6) Following incubation, aspirate the media and wash three times with 20 U/mL heparin PBS. Incubate cells with serum-containing media for a further 48 h or longer depending upon the assay for knockdown.
(7) Analyze cells by immunoblot, qPCR, phenotypic assay, or other appropriate method.

David Liu's lab has further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications.

(1) One day before treatment, plate 1×10⁵ per well in a 48-well plate.
(2) On the day of treatment, dilute purified 36 GFP protein in serum free media to a final concentration 2 mM. Add 1 mg of plasmid DNA. Vortex to mix and incubate at room temperature for 10 min.
(3) During incubation, aspirate media from cells and wash once with PBS.
(4) Following incubation of 36 GFP and plasmid DNA, gently add the protein-DNA complexes to cells.
(5) Incubate cells with complexes at 37 C for 4 h.
(6) Following incubation, aspirate the media and wash with PBS. Incubate cells in serum-containing media and incubate for a further 24-48 h.
(7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the CRISPR Cas system of the present invention.

Implantable Devices

In another embodiment, implantable devices are also contemplated for delivery of the CRISPR Cas system. For example, US Patent Publication 20110195123 discloses an implantable medical device which elutes a drug locally and in prolonged period is provided, including several types of such a device, the treatment modes of implementation and methods of implantation. The device comprising of polymeric substrate, such as a matrix for example, that is used as the device body, and drugs, and in some cases additional scaffolding materials, such as metals or additional polymers, and materials to enhance visibility and imaging. The selection of drug is based on the advantageous of releasing drug locally and in prolonged period, where drug is released directly to the extracellular matrix (ECM) of the diseased area such as tumor, inflammation, degeneration or for symptomatic objectives, or to injured smooth muscle cells, or for prevention. One kind of drug is the gene silencing drugs based on RNA interference (RNAi), including but not limited to si RNA, sh RNA, or antisense RNA/DNA, ribozyme and nucleoside analogs. Therefore, this system may be used/and or adapted to the CRISPR Cas system of the present invention. The modes of implantation in some embodiments are existing implantation procedures that are developed and used today for other treatments, including brachytherapy and needle biopsy. In such cases the dimensions of the new implant described in this invention are similar to the original implant. Typically a few devices are implanted during the same treatment procedure. As described in US Patent Publication 20110195123, there is provided a drug delivery implantable or insertable system, including systems applicable to a cavity such as the abdominal cavity and/or any other type of administration in which the drug delivery system is not anchored or attached, comprising a biostable and/or degradable and/or bioabsorbable polymeric substrate, which may for example optionally be a matrix. It should be noted that the term "insertion" also includes implantation. The drug delivery system is preferably implemented as a "Loder" as described in US Patent Publication 20110195123. The polymer or plurality of polymers are biocompatible, incorporating an agent and/or plurality of agents, enabling the release of agent at a controlled rate, wherein the total volume of the polymeric substrate, such as a matrix for example, in some embodiments is optionally and preferably no greater than a maximum volume that permits a therapeutic level of the agent to be reached. As a non-limiting example, such a volume is preferably within the range of 0.1 m³ to 1000 mm³, as required by the volume for the agent load. The Loder may optionally be larger, for example when incorporated with a device whose size is determined by functionality, for example and without limitation, a knee joint, an intra-uterine or cervical ring and the like. The drug delivery system (for delivering the composition) is designed in some embodiments to preferably employ degradable polymers, wherein the main release mechanism is bulk erosion; or in some embodiments, non degradable, or slowly degraded polymers are used, wherein the main release mechanism is diffusion rather than bulk erosion, so that the outer part functions as membrane, and its internal part functions as a drug reservoir, which practically is not affected by the surroundings for an extended period (for example from about a week to about a few months). Combinations of different polymers with different release mechanisms may also optionally be used. The concentration gradient at the surface is preferably maintained effectively constant during a significant period of the total drug releasing period, and therefore the diffusion rate is effectively constant (termed "zero mode" diffusion). By the term "constant" it is meant a diffusion rate that is preferably maintained above the lower threshold of therapeutic effectiveness, but which may still optionally feature an initial burst and/or fluctuate, for example increasing and decreasing to a certain degree. The diffusion rate is preferably so maintained for a prolonged period, and it can be considered constant to a certain level to optimize the therapeutically effective period, for example the effective silencing period. The drug delivery system optionally and preferably is designed to shield the nucleotide based therapeutic agent from degradation, whether chemical in nature or due to attack from enzymes and other factors in the body of the subject. The drug delivery system as described in US Patent Publication 20110195123 is optionally associated with sensing and/or activation appliances that are operated at and/or after implantation of the device, by non and/or minimally invasive methods of activation and/or acceleration/deceleration, for example optionally including but not limited to thermal heating and cooling, laser beams, and ultrasonic, including focused ultrasound and/or RF (radiofrequency) methods or devices. According to some embodiments of US Patent Publication 20110195123, the site for local delivery may optionally include target sites characterized by high abnormal proliferation of cells, and suppressed apoptosis, including tumors, active and or chronic inflammation and infection including autoimmune diseases states, degenerating tissue including muscle and nervous tissue, chronic pain, degenerative sites, and location of bone fractures and other wound locations for enhancement of regeneration of tissue, and injured cardiac, smooth and striated muscle. The site for implantation of the composition, or target site, preferably features a radius, area and/or volume that is sufficiently small for targeted local delivery. For example, the target site optionally has a diameter in a range of from about 0.1 mm to about 5 cm. The location of the target site is preferably selected for maximum therapeutic efficacy. For example, the composition of the drug delivery system (optionally with a device for implantation as described above) is optionally and preferably implanted within or in the proximity of a tumor environment, or the blood supply associated thereof. For example the composition (optionally with the device) is optionally implanted within or in the proximity to pancreas, prostate, breast, liver, via the nipple, within the vascular system and so forth. The target location is optionally selected from the group consisting of (as non-limiting examples only, as optionally any site within the body may be suitable for implanting a Loder): 1. brain at degenerative sites like in Parkinson or Alzheimer disease at the basal ganglia, white and gray matter; 2. spine as in the case of amyotrophic lateral sclerosis (ALS); 3. uterine cervix to prevent HPV infection; 4. active and chronic inflammatory joints; 5. dermis as in the case of psoriasis; 6. sympathetic and sensoric nervous sites for analgesic effect; 7. Intra osseous implantation; 8. acute and chronic infection sites; 9. Intra vaginal; 10. Inner ear-auditory system, labyrinth of the inner ear, vestibular system; 11. Intra tracheal; 12. Intra-cardiac; coronary, epicardiac; 13. urinary bladder; 14. biliary system; 15. parenchymal tissue including and not limited to the kidney, liver, spleen; 16. lymph nodes; 17. salivary glands; 18. dental gums; 19. Intra-articular (into joints); 20. Intra-ocular; 21. Brain tissue; 22. Brain ventricles; 23. Cavities, including abdominal cavity (for example but without limitation, for ovary cancer); 24. Intra esophageal and 25. Intra rectal. Optionally insertion of the system (for example a device containing the composition) is associated with injection of material to the ECM at the target site and the vicinity of that site to affect local pH and/or temperature and/or other biological factors affecting the diffusion of the drug and/or drug kinetics in the ECM, of the target site and the vicinity of such a site. Optionally, according to some embodiments, the release of said agent could be associated with sensing and/or activation appliances that are operated prior and/or at and/or after insertion, by non and/or minimally invasive and/or else methods of activation and/or acceleration/deceleration, including laser beam, radiation, thermal heating and cooling, and ultrasonic, including focused ultrasound and/or RF (radiofrequency) methods or devices, and chemical activators. According to other embodiments of US Patent Publication 20110195123, the drug preferably comprises a gene silencing biological RNAi drug, for example for localized cancer cases in breast, pancreas, brain, kidney, bladder, lung, and prostate as described below. Although examplifieid with RNAi, many drugs other than siRNA are applicable to be encapsulated in Loder, and can be used in association with this invention, as long as such drugs can be encapsulated with the Loder substrate, such as a matrix for example, and this system may be used and/or adapted to deliver the CRISPR Cas system of the present invention.

The method of insertion, such as implantation, may optionally already be used for other types of tissue implantation and/or for insertions and/or for sampling tissues, optionally without modifications, or alternatively optionally only with non-major modifications in such methods. Such methods optionally include but are not limited to brachytherapy methods, biopsy, endoscopy with and/or without ultrasound, such as ERCP, stereotactic methods into the brain tissue, Laparoscopy, including implantation with a laparoscope into joints, abdominal organs, the bladder wall and body cavities.

CRISPR Enzyme mRNA and Guide RNA

CRISPR enzyme mRNA and guide RNA might also be delivered separately. CRISPR enzyme mRNA can be delivered prior to the guide RNA to give time for CRISPR enzyme to be expressed. CRISPR enzyme mRNA might be administered 1-12 hours (preferably around 2-6 hours) prior to the administration of guide RNA. Alternatively, CRISPR enzyme mRNA and guide RNA can be administered together. Advantageously, a second booster dose of guide RNA can be administered 1-12 hours (preferably around 2-6 hours) after the initial administration of CRISPR enzyme mRNA+guide RNA. Additional administrations of CRISPR enzyme mRNA and/or guide RNA might be useful to achieve the most efficient levels of genome modification. For minimization of toxicity and off-target effect, it will be important to control the concentration of CRISPR enzyme mRNA and guide RNA delivered. Optimal concentrations of CRISPR enzyme mRNA and guide RNA can be determined by testing different concentrations in a cellular or animal model and using deep sequencing the analyze the extent of modification at potential off-target genomic loci. For example, for the guide sequence targeting 5'-GAGTCCGAGCAGAAGAAGAA-3' (SEQ ID NO: 19) in the EMX1 gene of the human genome, deep sequencing can be used to assess the level of modification at the following two off-target loci, 1: 5'-GAGTCCTAGCAG-GAGAAGAA-3' (SEQ ID NO: 20) and 2: 5'-GAGTCTAAGCAGAAGAAGAA-3' (SEQ ID NO: 21). The concentration that gives the highest level of on-target modification while minimizing the level of off-target modification should be chosen for in vivo delivery. Alternatively, to minimize the level of toxicity and off-target effect, CRISPR enzyme nickase mRNA (for example *S. pyogenes* Cas9 with the D10A mutation) can be delivered with a pair of guide RNAs targeting a site of interest. The two guide RNAs need to be spaced as follows. Guide sequences in red (single underline) and blue (double underline) respectively (these examples are based on the PAM requirement for *Streptococcus pyogenes* Cas9). Table 3.

TABLE 4

| Overhang length (bp) | Guide RNA design (guide sequence and PAM color coded) |
|---|---|
| 14 | 5'-NNNNNNNNNNNNNNNNNNNNNNNCCN━━━━━━━━━━━━N━NNNNNNNNNNNNNNN-3' (SEQ ID NO: 38) |
| 13 | 3'-NNNNNNNNNNNNNNNNNNNNNNNN━NN━━━━━━━━━━NCCNNNNNNNNNNNNNNN-5' (SEQ ID NO: 39) |
| 12 | 5'-NNNNNNNNNNNNNNNNNNNNNNNCC━━━━━━━━━━━N━NNNNNNNNNNNNNNN-3' (SEQ ID NO: 40) |
| 11 | 3'-NNNNNNNNNNNNNNNNNNNNNNNN━N━━━━━━━━━━CCNNNNNNNNNNNNNNN-5' (SEQ ID NO: 41) |
| 10 | 5'-NNNNNNNNNNNNNNNNNNNNNNNC━━━━━━━━━━━N━NNNNNNNNNNNNNNN-3' (SEQ ID NO: 42) |
| 9 | 3'-NNNNNNNNNNNNNNNNNNNNNNNN━N━━━━━━━━━━CCNNNNNNNNNNNNNNN-5' (SEQ ID NO: 43) |
| 8 | 5'-NNNNNNNNNNNNNNNNNNNNNNN━━━━━━━━━━━N━NNNNNNNNNNNNNNN-3' (SEQ ID NO: 44) |
| 7 | 3'-NNNNNNNNNNNNNNNNNNNNNNNN━N━━━━━━━━━━NNNNNNNNNNNNNNN-5' (SEQ ID NO: 45) |
| 6 | 5'-NNNNNNNNNNNNNNNNNNNNNNN━━━━━━━━━━━N━NNNNNNNNNNNNNNN-3' (SEQ ID NO: 46) |
| 5 | 3'-NNNNNNNNNNNNNNNNNNNNNNN━N━━━━━━━━━━NNNNNNNNNNNNNNN-5' (SEQ ID NO: 47) |
| 4 | 5'-NNNNNNNNNNNNNNNNNNNNNN━━━━━━━━━━━N━NNNNNNNNNNNNNNN-3' (SEQ ID NO: 48) |
| 3 | 3'-NNNNNNNNNNNNNNNNNNNNNN━N━━━━━━━━━━NNNNNNNNNNNNNNN-5' (SEQ ID NO: 49) |
| 2 | 5'-NNNNNNNNNNNNNNNNNNNNN━━━━━━━━━━━N━NNNNNNNNNNNNNNN-3' (SEQ ID NO: 50) |
| 1 | 3'-NNNNNNNNNNNNNNNNNNNNNN━N━━━━━━━━━━NNNNNNNNNNNNNNN-5' (SEQ ID NO: 51) blunt |
| 1 | 5'-NNNNNNNNNNNNNNNNNNN━━━━━━━━━━━N━NNNNNNNNNNNNNNN-3' (SEQ ID NO: 52) |
| 2 | 3'-NNNNNNNNNNNNNNNNNNNNNN━N━━━━━━━━━━NNNNNNNNNNNNNNN-5' (SEQ ID NO: 53) |
| 3 | 5'-NNNNNNNNNNNNNNNNNN━━━━━━━━━━━N━NNNNNNNNNNNNNNN-3' (SEQ ID NO: 54) |
| 4 | 3'-NNNNNNNNNNNNNNNNNNNNNN━N━━━━━━━━━━NNNNNNNNNNNNNNN-5' (SEQ ID NO: 55) |
| 5 | 5'-NNNNNNNNNNNNNNNNN━━━━━━━━━━━N━NNNNNNNNNNNNNNN-3' (SEQ ID NO: 56) |
| 6 | 3'-NNNNNNNNNNNNNNNNNNNNNN━N━━━━━━━━━━NNNNNNNNNNNNNNN-5' (SEQ ID NO: 57) |

TABLE 4-continued

| Overhang length (bp) | Guide RNA design (guide sequence and PAM color coded) |
|---|---|
| 7 | 5'-NNNNNNNNNNNNNN............N...NNNNNNNNNNNNNNNNNNNNNNNN-3'<br>(SEQ ID NO: 58) |
| 8 | 3'-NNNNNNNNNNNNNNNNNNNN...N............NNNNNNNNNNNNNNNNNN-5'<br>(SEQ ID NO: 59) |
| 12 | 5'-NNNNNNNNNNNNN............N...NNNNNNNNNNNNNNNNNNNNNNNN-3'<br>(SEQ ID NO: 60) |
| 13 | 3'-NNNNNNNNNNNNNNNNNNNN...N............NNNNNNNNNNNNNNNNNN-5'<br>(SEQ ID NO: 61) |
| 14 | 5'-NNNNNNNNNNNN............N...NNNNNNNNNNNNNNNNNNNNNNNN-3'<br>(SEQ ID NO: 62) |
| 15 | 3'-NNNNNNNNNNNNNNNNNNNN...N............NNNNNNNNNNNNNNNNNN-5'<br>(SEQ ID NO: 63) |
| 16 | 5'-NNNNNNNNNN............N...NNNNNNNNNNNNNNNNNNNNNNNN-3'<br>(SEQ ID NO: 64) |
| 17 | 3'-NNNNNNNNNNNNNNNNNNNN...N............NNNNNNNNNNNNNNNNNN-5'<br>(SEQ ID NO: 65) |
|  | 5'-NNNNNNNNN............N...NNNNNNNNNNNNNNNNNNNNNNNN-3'<br>(SEQ ID NO: 66) |
|  | 3'-NNNNNNNNNNNNNNNNNNNN...N............NNNNNNNNNNNNNNNNNN-5'<br>(SEQ ID NO: 67) |
|  | 5'-NNNNNNNN............N...NNNNNNNNNNNNNNNNNNNNNNNN-3'<br>(SEQ ID NO: 68) |
|  | 3'-NNNNNNNNNNNNNNNNNNNN...N............NNNNNNNNNNNNNNNNNN-5'<br>(SEQ ID NO: 69) |
|  | 5'-NNNNNNN............N...NNNNNNNNNNNNNNNNNNNNNNNN-3'<br>(SEQ ID NO: 70) |
|  | 3'-NNNNNNNNNNNNNNNNNNNN...N............NNNNNNNNNNNNNNNNNN-5'<br>(SEQ ID NO: 71) |
|  | 5'-NNNNNN............N...NNNNNNNNNNNNNNNNNNNNNNNN-3'<br>(SEQ ID NO: 72) |
|  | 3'-NNNNNNNNNNNNNNNNNNNN...N............NNNNNNNNNNNNNNNNNN-5'<br>(SEQ ID NO: 73) |
|  | 5'-NNNNN............N...NNNNNNNNNNNNNNNNNNNNNNNN-3'<br>(SEQ ID NO: 74) |
|  | 3'-NNNNNNNNNNNNNNNNNNNN...N............NNNNNNNNNNNNNNNNNN-5'<br>(SEQ ID NO: 75) |
|  | 5'-NNNN............N...NNNNNNNNNNNNNNNNNNNNNNNN-3'<br>(SEQ ID NO: 76) |

TABLE 4-continued

| Overhang length (bp) | Guide RNA design (guide sequence and PAM color coded) |
|---|---|
| | 3'-NNNNNNNNNNNNNNNNNNNN N NNNNNNNNNNNNNNNNNN-5' (SEQ ID NO: 77) |
| | 5'-NNN N NNNNNNNNNNNNNNNNNNNNNNNNNNNN-3' (SEQ ID NO: 78) |
| | 3'-NNNNNNNNNNNNNNNNNNNN N NNNNNNNNNNNNNNNNNN-5' (SEQ ID NO: 79) |
| | 5'-NN N NNNNNNNNNNNNNNNNNNNNNNNNNNNN-3' (SEQ ID NO: 80) |
| | 3'-NNNNNNNNNNNNNNNNNNNN N NNNNNNNNNNNNNNNNNN-5' (SEQ ID NO: 81) |
| | 5'-NN C NNNNNNNNNNNNNNNNNNNNNNNNNNNN-3' (SEQ ID NO: 82) |
| | 3'-NNNNNNNNNNNNNNNNNNNN C NNNNNNNNNNNNNNNNNN-5' (SEQ ID NO: 83) |
| | 5'-NN N NNNNNNNNNNNNNNNNNNNNNNNNNNNN-3' (SEQ ID NO: 84) |
| | 3'-NNNNNNNNNNNNNNNNNNNNNNCC N NNNNNNNNNNNNNN-5' (SEQ ID NO: 85) |
| | 5'-NN C NNNNNNNNNNNNNNNNNNNNNNNNNNNN-3' (SEQ ID NO: 86) |
| | 3'-NNNNNNNNNNNNNNNNNNNNNNCCN N NNNNNNNNNNNNNN-5' (SEQ ID NO: 87) |
| | 5'-NN C NNNNNNNNNNNNNNNNNNNNNNNNNNNN-3' (SEQ ID NO: 86) |
| | 3'-NNNNNNNNNNNNNNNNNNNNNNCCNN N NNNNNNNNNNNNN-5' (SEQ ID NO: 88) |
| | 5'-NN C NNNNNNNNNNNNNNNNNNNNNNNNNNNN-3' (SEQ ID NO: 86) |
| | 3'-NNNNNNNNNNNNNNNNNNNNNNCCNNN N NNNNNNNNNNNN-5' (SEQ ID NO: 89) |
| | 5'-NN C NNNNNNNNNNNNNNNNNNNNNNNNNNNN-3' (SEQ ID NO: 86) |
| | 3'-NNNNNNNNNNNNNNNNNNNNNNCCNNNN N NNNNNNNNNNN-5' (SEQ ID NO: 90) |
| | 5'-NN C NNNNNNNNNNNNNNNNNNNNNNNNNNNN-3' (SEQ ID NO: 86) |
| | 3'-NNNNNNNNNNNNNNNNNNNNNNCCNNNNN N NNNNNNNNNN-5' (SEQ ID NO: 91) |

Further interrogation of the system have given Applicants evidence of the 5' overhang (see, e.g., Ran et al., Cell. 2013 Sep. 12; 154(6):1380-9 and U.S. Provisional Patent Application Ser. No. 61/871,301 filed Aug. 28, 2013). Applicants have further identified parameters that relate to efficient cleavage by the Cas9 nickase mutant when combined with two guide RNAs and these parameters include but are not limited to the length of the 5' overhang. In embodiments of the invention the 5' overhang is at most 200 base pairs, preferably at most 100 base pairs, or more preferably at most 50 base pairs. In embodiments of the invention the 5' overhang is at least 26 base pairs, preferably at least 30 base pairs or more preferably 34-50 base pairs or 1-34 base pairs. In other preferred methods of the invention the first guide sequence directing cleavage of one strand of the DNA duplex near the first target sequence and the second guide sequence directing cleavage of other strand near the second target sequence results in a blunt cut or a 3' overhang. In embodiments of the invention the 3' overhang is at most 150, 100 or 25 base pairs or at least 15, 10 or 1 base pairs. In preferred embodiments the 3' overhang is 1-100 basepairs.

Aspects of the invention relate to the expression of the gene product being decreased or a template polynucleotide being further introduced into the DNA molecule encoding the gene product or an intervening sequence being excised precisely by allowing the two 5' overhangs to reanneal and ligate or the activity or function of the gene product being altered or the expression of the gene product being increased. In an embodiment of the invention, the gene product is a protein. sgRNA pairs creating 5' overhangs with less than 8 bp overlap between the guide sequences (offset greater than −8 bp) were able to mediate detectable indel formation. Importantly, each guide used in these assays is able to efficiently induce indels when paired with wildtype Cas9, indicating that the relative positions of the guide pairs are the most important parameters in predicting double nicking activity. Since Cas9n and Cas9H840A nick opposite strands of DNA, substitution of Cas9n with Cas9H840A with a given sgRNA pair should result in the inversion of the overhang type. For example, a pair of sgRNAs that will generate a 5' overhang with Cas9n should in principle generate the corresponding 3' overhang instead. Therefore, sgRNA pairs that lead to the generation of a 3' overhang with Cas9n might be used with Cas9H840A to generate a 5' overhang. Applicants tested Cas9H840A with a set of sgRNA pairs designed to generate both 5' and 3' overhangs (offset range from −278 to +58 bp), but were unable to observe indel formation, indicating that mutation Cas9H840A may substantially reduce Cas9 nuclease activity, thereby making sgRNA pairing as to mutant Cas9H840A as to double nicking of interest.

Liver, Proprotein Convertase Subtilisin Kexin 9 (PCSK9)

Bailey et al. (J Mol Med (Berl). 1999 January;77(1):244-9) discloses insulin delivery by ex-vivo somatic cell gene therapy involves the removal of non-B-cell somatic cells (e.g. fibroblasts) from a diabetic patient, and genetically altering them in vitro to produce and secrete insulin. The cells can be grown in culture and returned to the donor as a source of insulin replacement. Cells modified in this way could be evaluated before implantation, and reserve stocks could be cryopreserved. By using the patient's own cells, the procedure should obviate the need for immunosuppression and overcome the problem of tissue supply, while avoiding a recurrence of cell destruction. Ex-vivo somatic cell gene therapy requires an accessible and robust cell type that is amenable to multiple transfections and subject to controlled proliferation. Special problems associated with the use of non-B-cell somatic cells include the processing of proinsulin to insulin, and the conferment of sensitivity to glucose-stimulated proinsulin biosynthesis and regulated insulin release. Preliminary studies using fibroblasts, pituitary cells, kidney (COS) cells and ovarian (CHO) cells suggest that these challenges could be met, and that ex-vivo somatic cell gene therapy offers a feasible approach to insulin replacement therapy. The system of Bailey et al. may be used/and or adapted to the CRISPR Cas system of the present invention for delivery to the liver.

The methods of Sato et al. (Nature Biotechnology Volume 26 Number 4 Apr. 2008, Pages 431-442) may be applied to the CRISPR Cas system of the present invention for delivery to the liver. Sato et al. found that treatments with the siRNA-bearing vitamin A-coupled liposomes almost completely resolved liver fibrosis and prolonged survival in rats with otherwise lethal dimethylnitrosamine-induced liver cirrhosis in a dose- and duration-dependent manner. Cationic liposomes (Lipotrust) containing 0,0'-ditetradecanoyl-N-(a-trimethylammonioacetyl) diethanolamine chloride (DC-6-14) as a cationic lipid, cholesterol and dioleoylphosphatidylethanolamine at a molar ratio of 4:3:3 (which has shown high transfection efficiency under serum containing conditions for in vitro and in vivo gene delivery) were purchased from Hokkaido System Science. The liposomes were manufactured using a freeze-dried empty liposomes method and prepared at a concentration of 1 mM (DC-16-4) by addition of double-distilled water (DDW) to the lyophilized lipid mixture under vortexing before use. To prepare VA-coupled liposomes, 200 nmol of vitamin A (retinol, Sigma) dissolved in DMSO was mixed with the liposome suspensions (100 nmol as DC-16-4) by vortexing in a 1.5 ml tube at 25 1C. To prepare VA-coupled liposomes carrying siRNAgp46 (VA-lip-siRNAgp46), a solution of siRNAgp46 (580 μmol/ml in DDW) was added to the retinol-coupled liposome solution with stirring at 25 C. The ratio of siRNA to DC-16-4 was 1:11.5 (mol/mol) and the siRNA to liposome ratio (wt/wt) was 1:1. Any free vitamin A or siRNA that was not taken up by liposomes were separated from liposomal preparations using a micropartition system (VIVASPIN 2 concentrator 30,000 MWCO PES, VIVASCIENCE). The liposomal suspension was added to the filters and centrifuged at 1,500 g for 5 min 3 times at 25 1C. Fractions were collected and the material trapped in the filter was reconstituted with PBS to achieve the desired dose for in vitro or in vivo use. Three injections of 0.75 mg/kg siRNA were given every other day to rats. The system of Sato et al. may be used/and or adapted to the CRISPR Cas system of the present invention for delivery to the liver by delivering about 0.5 to 1 mg/kg of CRISPR Cas RNA in the liposomes as described by Sato et al. to humans.

The methods of Rozema et al. (PNAS, Aug. 7, 2007, vol. 104, no. 32) for a vehicle for the delivery of siRNA to hepatocytes both in vitro and in vivo, which Rozema et al. have named siRNA Dynamic PolyConjugates may also be applied to the present invention. Key features of the Dynamic Poly-Conjugate technology include a membrane-active polymer, the ability to reversibly mask the activity of this polymer until it reaches the acidic environment of endosomes, and the ability to target this modified polymer and its siRNA cargo specifically to hepatocytes in vivo after simple, low-pressure i.v. injection. SATA-modified siRNAs are synthesized by reaction of 5' aminemodified siRNA with 1 weight equivalents (wt eq) of Nsuccinimidyl-S-acetylthioacetate (SATA) reagent (Pierce) and 0.36 wt eq of NaHCO$_3$ in water at 4° C. for 16 h. The modified siRNAs are then precipitated by the addition of 9 vol of ethanol and incubation at 80° C. for 2 h. The precipitate is resuspended in 1× siRNA buffer (Dharmacon) and quantified by measuring absorbance at the 260-nm wavelength. PBAVE (30 mg/ml in 5 mMTAPS, pH 9) is modified by addition of 1.5 wt % SMPT (Pierce). After a 1-h incubation, 0.8 mg of SMPT-PBAVE was added to 400 µl of isotonic glucose solution containing 5 mM TAPS (pH 9). To this solution was added 50 µg of SATA-modified siRNA. For the dose-response experiments where [PBAVE] was constant, different amounts of siRNA are added. The mixture is then incubated for 16 h. To the solution is then added 5.6 mg of Hepes free base followed by a mixture of 3.7 mg of CDM-NAG and 1.9 mg of CDM-PEG. The solution is then incubated for at least 1 h at room temperature before injection. CDM-PEG and CDM-NAG are synthesized from the acid chloride generated by using oxalyl chloride. To the acid chloride is added 1.1 molar equivalents polyethylene glycol monomethyl ether (molecular weight average of 450) to generate CDM-PEG or (aminoethoxy)ethoxy-2-(acetylamino)-2-deoxy-β-D-glucopyranoside to generate CDM-NAG. The final product is purified by using reverse-phase HPLC with a 0.1% TFA water/acetonitrile gradient. About 25 to 50 µg of siRNA was delivered to mice. The system of Rozema et al. may be applied to the CRISPR Cas system of the present invention for delivery to the liver, for example by envisioning a dosage of about 50 to about 200 mg of CRISPR Cas for delivery to a human.

Brain

Delivery options for the brain include encapsulation of CRISPR enzyme and guide RNA in the form of either DNA or RNA into liposomes and conjugating to molecular Trojan horses for trans-blood brain barrier (BBB) delivery. Molecular Trojan horses have been shown to be effective for delivery of B-gal expression vectors into the brain of non-human primates. The same approach can be used to delivery vectors containing CRISPR enzyme and guide RNA. For instance, Xia C F and Boado R J, Pardridge W M ("Antibody-mediated targeting of siRNA via the human insulin receptor using avidin-biotin technology." Mol Pharm. 2009 May-Jun;6(3):747-51. doi: 10.1021/mp800194) describes how delivery of short interfering RNA (siRNA) to cells in culture, and in vivo, is possible with combined use of a receptor-specific monoclonal antibody (mAb) and avidin-biotin technology. The authors also report that because the bond between the targeting mAb and the siRNA is stable with avidin-biotin technology, and RNAi effects at distant sites such as brain are observed in vivo following an intravenous administration of the targeted siRNA.

Zhang et al. (Mol Ther. 2003 January;7(1):11-8.)) describe how expression plasmids encoding reporters such as luciferase were encapsulated in the interior of an "artificial virus" comprised of an 85 nm pegylated immunoliposome, which was targeted to the rhesus monkey brain in vivo with a monoclonal antibody (MAb) to the human insulin receptor (HIR). The HIRMAb enables the liposome carrying the exogenous gene to undergo transcytosis across the blood-brain barrier and endocytosis across the neuronal plasma membrane following intravenous injection. The level of luciferase gene expression in the brain was 50-fold higher in the rhesus monkey as compared to the rat. Widespread neuronal expression of the beta-galactosidase gene in primate brain was demonstrated by both histochemistry and confocal microscopy. The authors indicate that this approach makes feasible reversible adult transgenics in 24 hours. Accordingly, the use of immunoliposome is preferred. These may be used in conjunction with antibodies to target specific tissues or cell surface proteins. Other means of delivery or RNA are also preferred, such as via nanoparticles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641).

Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then siRNA is loaded into the exosomes. Delivery or administration according to the invention can be performed with exosomes, in particular but not limited to the brain. Vitamin E (α-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free TocsiBACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to α-tocopherol and co-administered with HDL targeted to the brain may be contemplated for humans in the present invention, for example, about 3 nmol to about 3 µmol of CRISPR Cas targeted to the brain may be contemplated.

Zou et al. ((HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 µl of a recombinant lentivirus having a titer of $1 \times 10^9$ transducing units (TU)/ml by an intrathecal catheter. A similar dosage of CRISPR Cas expressed in a lentiviral vector targeted to the brain may be contemplated for humans in the present invention, for example, about 10-50 ml of CRISPR Cas targeted to the brain in a lentivirus having a titer of $1 \times 10^9$ transducing units (TU)/ml may be contemplated.

In terms of local delivery to the brain, this can be achieved in various ways. For instance, material can be delivered intrastriatally e.g. by injection. Injection can be performed stereotactically via a craniotomy.

Targeted Deletion, Therapeutic Applications

Targeted deletion of viral genes or other viral elements is preferred. Examples are exemplified in Example 18. Preferred are, therefore, latent viral genes. As exemplified here, Applicants prefer gene delivery of a CRISPR-Cas system to the liver, brain, ocular, epithelial, hematopoetic, or another tissue of a subject or a patient in need thereof, suffering from latent viral infections, using either viral or nonviral (e.g. nanoparticle) delivery system.

Therapeutic applications of the CRISPR-Cas system include treatment of viral infections, such as HBV infection.

Chronic administration of protein therapeutics may elicit unacceptable immune responses to the specific protein. The immunogenicity of protein drugs can be ascribed to a few immunodominant helper T lymphocyte (HTL) epitopes. Reducing the MHC binding affinity of these HTL epitopes contained within these proteins can generate drugs with lower immunogenicity (Tangri S, et al. ("Rationally engineered therapeutic proteins with reduced immunogenicity" J Immunol. 2005 Mar. 15; 174(6):3187-96.) In the present invention, the immunogenicity of the CRISPR enzyme in particular may be reduced following the approach first set out in Tangri et al with respect to erythropoietin and subsequently developed. Accordingly, directed evolution or rational design may be used to reduce the immunogenicity of the CRISPR enzyme (for instance a Cas9) in the host species (human or other species).

Applicants used 3 guideRNAs of interest and able to visualize efficient DNA cleavage in vivo occurring only in a small subset of cells. Essentially, what Applicants have shown here is targeted in vivo cleavage. In particular, this provides proof of concept that specific targeting in higher organisms such as mammals can also be achieved. It also highlights multiplex aspect in that multiple guide sequences (i.e. separate targets) can be used simultaneously (in the sense of co-delivery). In other words, Applicants used a multiple approach, with several different sequences targeted at the same time, but independently.

A suitable example of a protocol for producing AAV, a preferred vector of the invention is provided in the Examples.

Blood

The present invention also contemplates delivering the CRISPR-Cas system to the blood. The plasma exosomes of Wahlgren et al. (Nucleic Acids Research, 2012, Vol. 40, No. 17 e130) were previously described and may be utilized to deliver the CRISPR Cas system to the blood.

Heart

The present invention also contemplates delivering the CRISPR-Cas system to the heart. For the heart, a myocardium tropic adena-associated virus (AAVM) is preferred, in particular AAVM41 which showed preferential gene transfer in the heart (see, e.g., Lin-Yanga et al., PNAS, Mar. 10, 2009, vol. 106, no. 10). Administration may be systemic or local. A dosage of about $1\text{-}10\times10^{14}$ vector genomes are contemplated for systemic administration. See also, e.g., Eulalio et al. (2012) Nature 492: 376 and Somasuntharam et al. (2013) Biomaterials 34: 7790.

Kidneys

The present invention also contemplates delivering the CRISPR-Cas system to the kidney. Delivery strategies to induce cellular uptake of the therapeutic nucleic acid include physical force or vector systems such as viral-, lipid- or complex-based delivery, or nanocarriers. From the initial applications with less possible clinical relevance, when nucleic acids were addressed to renal cells with hydrodynamic high pressure injection systemically, a wide range of gene therapeutic viral and non-viral carriers have been applied already to target posttranscriptional events in different animal kidney disease models in vivo (Csaba Révész and Péter Hamar (2011). Delivery Methods to Target RNAs in the Kidney, Gene Therapy Applications, Prof. Chunsheng Kang (Ed.), ISBN: 978-953-307-541-9, InTech, Available from: (www.intechopen.com/books/gene-therapy-applications/delivery-methods-to-target-rnas-in-the-kidney). Delivery methods to the kidney are summarized as follows:

| Delivery method | Carrier | Target RNA | Disease | Model | Functional assays | Author |
|---|---|---|---|---|---|---|
| Hydro-dynamic/ Lipid | TransIT In Vivo Gene Delivery System, DOTAP | p85α | Acute renal injury | Ischemia-reperfusion | Uptake, biodistribution | Larson et al., Surgery, (August 2007), Vol. 142, No. 2, pp. (262-269) |
| Hydro-dynamic/ Lipid | Lipo-fectamine 2000 | Fas | Acute renal injury | Ischemia-reperfusion | Blood urea nitrogen, Fas Immuno-histochemistry, apoptosis, histological scoring | Hamar et al., Proc Natl Acad Sci. (October 2004), Vol. 101, No. 41, pp. (14883-14888) |
| Hydro-dynamic | n.a. | Apoptosis cascade elements | Acute renal injury | Ischemia-reperfusion | n.a. | Zheng et al., Am J Pathol, (October 2008), Vol. 173, No. 4, pp. (973-980) |
| Hydro-dynamic | n.a. | Nuclear factor kappa-b (NFkB) | Acute renal injury | Ischemia-reperfusion | n.a. | Feng et al., Transplantation, (May 2009), Vol. 87, No. 9, pp. (1283-1289) |
| Hydro-dynamic/ Viral | Lipo-fectamine 2000 | Apoptosis antagonizing transcription factor (AATF) | Acute renal injury | Ischemia-reperfusion | Apoptosis, oxidative stress, caspase activation, membrane lipid peroxidation | Xie & Guo, Am Soc Nephrol, (December 2006), Vol. 17, No. 12, pp. (3336-3346) |

-continued

| Delivery method | Carrier | Target RNA | Disease | Model | Functional assays | Author |
|---|---|---|---|---|---|---|
| Hydrodynamic | pBAsi mU6 Neo/TransIT-EE Hydrodynamic Delivery System | Gremlin | Diabetic nephropathy | Streptozotozin-induced diabetes | Proteinuria, serum creatinine, glomerular and tubular diameter, collagen type IV/BMP7 expression | Q. Zhang et al., PloS ONE, (July 2010), Vol. 5, No. 7, e11709, pp. (1-13) |
| Viral/Lipid | pSUPER vector/Lipofectamine | TGF-β type II receptor | Interstitial renal fibrosis | Unilateral urethral obstruction | α-SMA expression, collagen content. | Kushibikia et al., J Controlled Release, (July 2005), Vol. 105, No. 3, pp. (318-331) |
| Viral | Adeno-associated virus-2 | Mineral corticoid receptor | Hypertension caused renal damage | Cold-induced hypertension | blood pressure, serum albumin, serum urea nitrogen, serum creatinine, kidney weight, urinary sodium | Wang et al., Gene Therapy, (July 2006), Vol. 13, No. 14, pp. (1097-1103) |
| Hydrodynamic/Viral | pU6 vector | Lucifcrase | n.a. | n.a. | uptake | Kobayashi et al., Journal of Pharmacology and Experimental Therapeutics, (February 2004), Vol. 308, No. 2, pp. (688-693) |
| Lipid | Lipoproteins, albumin | apoB1, apoM | n.a. | n.a. | Uptake, binding affinity to lipoproteins and albumin | Wolfrum et al., Nature Biotechnology, (September 2007), Vol. 25, No. 10, pp. (1149-1157) |
| Lipid | Lipofectamine2000 | p53 | Acute renal injury | Ischemic and cisplatin-induced acute injury | Histological scoring, apoptosis | Molitoris etal., J Am Soc Nephrol, (August 2009), Vol. 20, No. 8, pp. (1754-1764) |
| Lipid | DOTAP/DOPE, DOTAP/DOPE/DOPE-PEG2000 | COX-2 | Breast adenocarcinoma | MDA-MB-231 breast cancer xenograft-bearing mouse | Cell viability, uptake | Mikhaylova et al., Cancer Gene Therapy (March 2011), Vol. 16, No. 3, pp. (217-226) |
| Lipid | Cholesterol | 12/15-lipoxygenase | Diabetic nephropathy | Streptozotocin-induced diabetes | Albuminuria, urinary creatinine, histology, type I and IV collagen, TGF-β, fibronectin, plasminogen activator inhibitor 1 | Yuan et al., Am J Physiol Renal Physiol (June 2008), Vol. 295, pp. (F605-F617) |
| Lipid | Lipofectamine 2UUU | Mitochondrial membrane 44 (TIM44) | Diabetic nephropathy | Streptozotocin-induced diabetes | Cell proliferation and apoptosis, histology, ROS, mitochondrial import of Mn-SOD and glutathione peroxidase, cellular membrane polarization | Y. Zhang et al., J Am Soc Nephrol, (April 2006), Vol. 17, No. 4, pp. (1090-1101) |
| Hydrodynamic/Lipid | Proteoliposome | RLIP76 | Renal carcinoma | Caki-2 kidney cancer xenograft-bearing mouse | uptake | Singhal et al., Cancer Res, (May 2009), Vol. 69, No. 10, pp. (4244-4251) |
| Polymer | PEGylated PEI | Luciferase pGL3 | n.a. | n.a. | Uptake, biodistribution, erythrocyte aggregation | Malek et al., Toxicology and Applied Pharmacology, (April 2009), Vol. 236, No. 1, pp. (97-108) |

-continued

| Delivery method | Carrier | Target RNA | Disease | Model | Functional assays | Author |
|---|---|---|---|---|---|---|
| Polymer | PEGylated poly-L-lysine | MAPK1 | Lupus glomerulonephritis | Glomerulonephritis | Proteinuria, glomerulosclerosis, TGF-β fibronectin, plasminogen activator inhibitor 1 | Shimizu et al. J Am Soc Nephrology, (April 2010), Vol. 21, No. 4, pp. (622-633) |
| Polymer/Nano particle | Hyaluronic acid/Quantum dot/PEI | VEGF | Kidney cancer/melanoma | B16F1 melanoma tumor-bearing mouse | Biodistribution, citotoxicity, tumor volume, endocytosis | Jiang et al, Molecular Pharmaceutics, (May-June 2009), Vol. 6, No. 3, pp. (727-737) |
| Polymer/Nano particle | PEGylated polycaprolactone nanofiber | GAPDH | n.a. | n.a. | cell viability, uptake | Cao et al, J Controlled Release, (June 2010). Vol. 144, No. 2, pp. (203-212) |
| Aptamer | Spiegelmer mNOX-E36 | CC chemokine ligand 2 | Glomerulo sclerosis | Uninephrectomized mouse | urinary albumin, urinary creatinine, histopathology, glomerular filtration rate, macrophage count, serum Ccl2. Mac-2+, Ki-67+ | Ninichuk et al., Am J Pathol, (March 2008), Vol. 172, No. 3, pp. (628-637) |
| Aptamer | Aptamer NOX-F37 | vasopressin (AVP) | Congestive heart failure | n.a. | Binding affinity to D-AVP, Inhibition of AVP Signaling, Urine osmolality and sodium concentration, | Purschke et al., Proc Natl Acad Sci, (March 2006), Vol. 103, No. 13, pp. (5173-5178) |

Lungs

The present invention also contemplates delivering the CRISPR-Cas system to one or both lungs. Although AAV-2-based vectors were originally proposed for CFTR delivery to CF airways, other serotypes such as AAV-1, AAV-5, AAV-6, and AAV-9 exhibit improved gene transfer efficiency in a variety of models of the lung epithelium (see, e.g., Li et al., Molecular Therapy, vol. 17 no. 12, 2067-277 Dec. 2009). AAV-1 was demonstrated to be ~100-fold more efficient than AAV-2 and AAV-5 at transducing human airway epithelial cells in vitro,5 although AAV-1 transduced murine tracheal airway epithelia in vivo with an efficiency equal to that of AAV-5. Other studies have shown that AAV-5 is 50-fold more efficient than AAV-2 at gene delivery to human airway epithelium (HAE) in vitro and significantly more efficient in the mouse lung airway epithelium in vivo. AAV-6 has also been shown to be more efficient than AAV-2 in human airway epithelial cells in vitro and murine airways in vivo.8 The more recent isolate, AAV-9, was shown to display greater gene transfer efficiency than AAV-5 in murine nasal and alveolar epithelia in vivo with gene expression detected for over 9 months suggesting AAV may enable long-term gene expression in vivo, a desirable property for a CFTR gene delivery vector. Furthermore, it was demonstrated that AAV-9 could be readministered to the murine lung with no loss of CFTR expression and minimal immune consequences. CF and non-CF HAE cultures may be inoculated on the apical surface with 100 μl of AAV vectors for hours (see, e.g., Li et al., Molecular Therapy, vol. 17 no. 12, 2067-277 Dec. 2009). The MOI may vary from $1 \times 10^3$ to $4 \times 10^5$ vector genomes/cell, depending on virus concentration and purposes of the experiments. The above cited vectors are contemplated for the delivery and/or administration of the invention.

Zamora et al. (Am J Respir Crit Care Med Vol 183. pp 531-538, 2011) reported an example of the application of an RNA interference therapeutic to the treatment of human infectious disease and also a randomized trial of an antiviral drug in respiratory syncytial virus (RSV)-infected lung transplant recipients. Zamora et al. performed a randomized, double-blind, placebo controlled trial in LTX recipients with RSV respiratory tract infection. Patients were permitted to receive standard of care for RSV. Aerosolized ALN-RSV01 (0.6 mg/kg) or placebo was administered daily for 3 days. This study demonstrates that an RNAi therapeutic targeting RSV can be safely administered to LTX recipients with RSV infection. Three daily doses of ALN-RSV01 did not result in any exacerbation of respiratory tract symptoms or impairment of lung function and did not exhibit any systemic proinflammatory effects, such as induction of cytokines or CRP. Pharmacokinetics showed only low, transient systemic exposure after inhalation, consistent with preclinical animal data showing that ALN-RSV01, administered intravenously or by inhalation, is rapidly cleared from the circulation through exonuclease mediated digestion and renal excretion. The method of Zamora et al. may be applied to the CRISPR Cas system of the present invention and an aerosolized CRISPR Cas, for example with a dosage of 0.6 mg/kg, may be contemplated for the present invention.

Muscles

The present invention also contemplates delivering the CRISPR-Cas system to muscle(s).

Skin

The present invention also contemplates delivering the CRISPR-Cas system to the skin. Hickerson et al. (Molecular Therapy-Nucleic Acids (2013) 2, e129) relates to a motorized microneedle array skin delivery device for delivering self-delivery (sd)-siRNA to human and murine skin. The primary challenge to translating siRNA-based skin therapeutics to the clinic is the development of effective delivery systems. Substantial effort has been invested in a variety of skin delivery technologies with limited success. In a clinical study in which skin was treated with siRNA, the exquisite pain associated with the hypodermic needle injection precluded enrollment of additional patients in the trial, highlighting the need for improved, more "patient-friendly" (i.e., little or no pain) delivery approaches. Microneedles represent an efficient way to deliver large charged cargos including siRNAs across the primary barrier, the stratum corneum, and are generally regarded as less painful than conventional hypodermic needles. Motorized "stamp type" microneedle devices, including the motorized microneedle array (MMNA) device used by Hickerson et al., have been shown to be safe in hairless mice studies and cause little or no pain as evidenced by (i) widespread use in the cosmetic industry and (ii) limited testing in which nearly all volunteers found use of the device to be much less painful than a flushot, suggesting siRNA delivery using this device will result in much less pain than was experienced in the previous clinical trial using hypodermic needle injections. The MMNA device (marketed as Triple-M or Tri-M by Bomtech Electronic Co, Seoul, South Korea) was adapted for delivery of siRNA to mouse and human skin. sd-siRNA solution (up to 300 µl of 0.1 mg/ml RNA) was introduced into the chamber of the disposable Tri-M needle cartridge (Bomtech), which was set to a depth of 0.1 mm. For treating human skin, deidentified skin (obtained immediately following surgical procedures) was manually stretched and pinned to a cork platform before treatment. All intradermal injections were performed using an insulin syringe with a 28-gauge 0.5-inch needle. The MMNA device and method of Hickerson et al. could be used and/or adapted to deliver the CRISPR Cas of the present invention, for example, at a dosage of up to 300 µl of 0.1 mg/ml CRISPR Cas to the skin.

Latent and Chronic Viral Infections

The present invention may also be applied to treat latent or chronic viral infections. Viral latency is the ability of a pathogenic virus to remain latent or dormant within a cell during the lysogenic part of its life cycle. Latent infection is distinct from chronic infection in which a virus continues to replicate and proliferate. Instead, proliferation of the virus ceases but the viral genome is not eradicated, and so it can reactivate and again result in production of viral progeny (lytic part of the life cycle) without requiring reinfection of the host. Thus the invention provides the use of a CRISPR-Cas system to inactivate a virus within a eukaryotic cell, and in particular a latent form of the virus. For instance, the CRISPR-Cas system can be used to excise an integrated provirus from a cell's genome and/or to inactivate a latent virus which is present in episomal form (e.g. to cleave a cccDNA form).

Thus the invention provides a CRISPR-Cas system comprising one or more vectors for delivery to a eukaryotic cell, wherein the vector(s) encode(s): (i) a CRISPR enzyme; (ii) a guide RNA capable of hybridizing to a target sequence in a viral genome within the cell; and (iii); a tracr mate sequence; and (iv) a tracr sequence, wherein, when expressed within the cell, the guide RNA directs sequence-specific binding of a CRISPR complex to the target sequence, and the CRISPR complex comprises (a) the tracr mate sequence hybridised to the tracr sequence and (b) a CRISPR enzyme bound to the guide RNA, such that the guide RNA can hybridise to its target sequence in the viral genome.

Further characteristics of the vector(s), the encoded enzyme, the guide sequences, etc. are disclosed elsewhere herein. For instance, the guide sequences can be part of a chiRNA sequence which provides the guide, tracr mate and tracr sequences within a single RNA, such that the system can encode (i) a CRISPR enzyme; (ii) a chiRNA comprising a sequence capable of hybridizing to a target sequence in a viral genome, a tracr mate sequence, and a tracr sequence. Similarly, the enzyme can include one or more NLS, etc.

Latent viruses can exist in episomal form or integrated proviral form, and the invention can be used to treat both types. The invention is particularly useful with DNA viruses, and especially viruses with a double-stranded DNA genome. Examples of pathogenic DNA viruses which have an episomal latent form herpes simplex virus (HSV) 1 and 2, human papillomavirus (HPV) of any type, Epstein Barr virus (EBV), and varicella zoster virus (VZV). The invention can be used to treat infections with any of these viruses. Some plant viruses also exhibit a latent form and the invention can be used to eliminate these as well. CRISPR systems of the invention can be targeted to cell types which maintain a latent virus e.g. B cells or epithelial cells for EBV, neurons for HSV and VZV, epithelial cells for HPV, liver cells for HBV, etc. Genomic sequences for viruses are widely available, and guide sequences for targeting the viral genome can thus be designed without difficulty. Where a virus has various sequence variants (e.g. different subtypes of HBV) it is useful to design guide sequences to target regions of the genome which are conserved, thereby providing broad activity. It is preferred to use guide RNAs against more than one site in the viral genome. A key advantage of CRISPR technology when compared to ZFNs or TALENs is the relative ease by which multiple sequences can be targeted. Targeting multiple sites in a viral genome offers two main advantages. Firstly, it reduces the possibility that a viral strain might escape (e.g. by mutation), and helps to ensure that at least one target is present in any subject's unique ensemble of genomes and variants or quasispecies. Secondly, because episomeal forms are generally small and circular (~3-4 kb), targeting multiple sites with different guides may allow fragmentation of the episome into multiple pieces that cannot easily be repaired by NHEJ. Thus, for example, a CRISPR system can target multiple genes or ORFs within a viral genome. As well as targeting latent viruses, CRISPR systems can be used to target chronic viral infections by viruses whose life cycles include a dsDNA form which can be bound by CRISPR complexes. In these embodiments the CRISPR system can be used in conjunction with an antiviral compound, such as tenofovir (HBV), entecavir (HBV), aciclovir (HSV, VZV), etc.

Hepatitis Viruses

The present invention may also be applied to treat hepatitis B virus (HBV). Thus the invention provides the use of a CRISPR-Cas system to inactivate HBV within a mammalian cell, and in particular a latent form of HBV. For instance, the CRISPR-Cas system can be used to excise integrated HBV provirus from a cell's genome (a rare occurrence) and/or to inactivate latent HBV which is present in covalently closed circular DNA (cccDNA) form. HBV genomic sequences are widely available, and guide sequences for targeting the HBV genome can thus be designed without difficulty. HBV exists in several serological subtypes (e.g. adw, ayw, ady, adr), which differ by >8% in primary sequence, and it is useful to design guide sequences to target regions of the genome which are conserved between multiple subtypes. Applicants have designed 24 guide RNAs to target the HBV genome. These include targets which are highly conserved within the HBV genome; and the location of 9 of these guide sequences is mapped against the HBV genome (See FIGS. 36, 57). It is preferred to use guide RNAs against more than one site in the HBV genome. For instance, it is useful to provide guide sequences which recognise two or more of: ORF S, which encodes the surface antigen; ORF C, which encodes core protein; ORF P, which encodes the polymerase; ORF X, which encodes HBX protein; the EnhI enhancer regulatory element; and/or the EnhII enhancer regulatory element. CRISPR systems for treating HBV are ideally delivered to liver cells, and in particular to hepatocytes. Thus an AAV8 vector may be useful. Similarly, expression of the components of the CRISPR system are ideally under the transcriptional control of a liver-specific or hepatocyte-specific promoter.

The CRISPR system can be used in conjunction with an anti-HBV compound such as tenofovir or entecavir. As Cas9 targeting to cccDNA is likely at least partially dependent on the cccDNA structure, co-treatment with epigenetic modifiers (for example Class I and Class III HDAC inhibitors trichostatin A (TSA), valproate, and nicotinamide (NAM), and Type I interferons) may be useful for increasing Cas9 occupancy on HBV cccDNA. For treating HBV in practice, the CRISPR Cas system must avoid the shortcomings of RNAi, such as the risk of oversaturating endogenous small RNA pathways, by for example, optimizing dose and sequence (see, e.g., Grimm et al., Nature vol. 441, 26 May 2006). For example, low doses, such as about $1-10\times10^{14}$ particles per human are contemplated. In another embodiment, the CRISPR Cas system directed against HBV may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of CRISPR Cas targeted to HBV RNA in a SNALP are contemplated. The daily treatment may be over about three days and then weekly for about five weeks. In another embodiment, the system of Chen et al. (Gene Therapy (2007) 14, 11-19) may be used/and or adapted for the CRISPR Cas system of the present invention. Chen et al. use a double-stranded adeno-associated virus 8-pseudotyped vector (dsAAV2/8) to deliver shRNA. A single administration of dsAAV2/8 vector ($1\times10^{12}$ vector genomes per mouse), carrying HBV-specific shRNA, effectively suppressed the steady level of HBV protein, mRNA and replicative DNA in liver of HBV transgenic mice, leading to up to 2-3 $\log_{10}$ decrease in HBV load in the circulation. Significant HBV suppression sustained for at least 120 days after vector administration. The therapeutic effect of shRNA was target sequence dependent and did not involve activation of interferon. For the present invention, a CRISPR Cas system directed to HBV may be cloned into an AAV vector, such as a dsAAV2/8 vector and administered to a human, for example, at a dosage of about $1\times10^{15}$ vector genomes to about $1\times10^{16}$ vector genomes per human. In another embodiment, the method of Wooddell et al. (Molecular Therapy vol. 21 no. 5, 973-985 May 2013) may be used/and or adapted to the CRISPR Cas system of the present invention. Woodell et al. show that simple coinjection of a hepatocyte-targeted, N-acetylgalactosamine-conjugated melittin-like peptide (NAG-MLP) with a liver-tropic cholesterol-conjugated siRNA (chol-siRNA) targeting coagulation factor VII (F7) results in efficient F7 knockdown in mice and nonhuman primates without changes in clinical chemistry or induction of cytokines. Using transient and transgenic mouse models of HBV infection, Wooddell et al. show that a single coinjection of NAG-MLP with potent chol-siRNAs targeting conserved HBV sequences resulted in multilog repression of viral RNA, proteins, and viral DNA with long duration of effect. Intraveinous coinjections, for example, of about 6 mg/kg of NAG-MLP and 6 mg/kg of HBV specific CRISPR Cas may be envisioned for the present invention. In the alternative, about 3 mg/kg of NAG-MLP and 3 mg/kg of HBV specific CRISPR Cas may be delivered on day one, followed by administration of about about 2-3 mg/kg of NAG-MLP and 2-3 mg/kg of HBV specific CRISPR Cas two weeks later.

The present invention may also be applied to treat hepatitis C virus (HCV). The methods of Roelvinki et al. (Molecular Therapy vol. 20 no. 9, 1737-1749 Sep. 2012) may be applied to the CRISPR Cas system. For example, an AAV vector such as AAV8 may be a contemplated vector and for example a dosage of about $1.25\times10^{11}$ to $1.25\times10^{13}$ vector genomes per kilogram body weight (vg/kg) may be contemplated.

It will be readily apparent that a host of other viruses can be treated in a similar fashion.

Nucleic Acids, Amino Acids and Proteins

The invention uses nucleic acids to bind target DNA sequences. This is advantageous as nucleic acids are much easier and cheaper to produce than proteins, and the specificity can be varied according to the length of the stretch where homology is sought. Complex 3-D positioning of multiple fingers, for example is not required. The terms "polynucleotide", "nucleotide", "nucleotide sequence", "nucleic acid" and "oligonucleotide" are used interchangeably. They refer to a polymeric form of nucleotides of any length, either deoxyribonucleotides or ribonucleotides, or analogs thereof. Polynucleotides may have any three dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, short interfering RNA (siRNA), short-hairpin RNA (shRNA), micro-RNA (miRNA), ribozymes, cDNA, recombinant polynucleotides, branched polynucleotides, plasmids, vectors, isolated DNA of any sequence, isolated RNA of any sequence, nucleic acid probes, and primers. The term also encompasses nucleic-acid-like structures with synthetic backbones, see, e.g., Eckstein, 1991; Baserga et al., 1992; Milligan, 1993; WO 97/03211; WO 96/39154; Mata, 1997; Strauss-Soukup, 1997; and Samstag, 1996. A polynucleotide may comprise one or more modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

As used herein the term "wild type" is a term of the art understood by skilled persons and means the typical form of an organism, strain, gene or characteristic as it occurs in nature as distinguished from mutant or variant forms.

As used herein the term "variant" should be taken to mean the exhibition of qualities that have a pattern that deviates from what occurs in nature.

The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature.

"Complementarity" refers to the ability of a nucleic acid to form hydrogen bond(s) with another nucleic acid sequence by either traditional Watson-Crick base pairing or other non-traditional types. A percent complementarity indicates the percentage of residues in a nucleic acid molecule which can form hydrogen bonds (e.g., Watson-Crick base pairing) with a second nucleic acid sequence (e.g., 5, 6, 7, 8, 9, 10 out of 10 being 50%, 60%, 70%, 80%, 90%, and 100% complementary). "Perfectly complementary" means that all the contiguous residues of a nucleic acid sequence will hydrogen bond with the same number of contiguous residues in a second nucleic acid sequence. "Substantially complementary" as used herein refers to a degree of complementarity that is at least 60%, 65%, 70%, 75%, 80%, 85%, 90%, 95%, 97%, 98%, 99%, or 100% over a region of 8, 9, 10, 11, 12, 13, 14, 15, 16, 17, 18, 19, 20, 21, 22, 23, 24, 25, 30, 35, 40, 45, 50, or more nucleotides, or refers to two nucleic acids that hybridize under stringent conditions.

As used herein, "stringent conditions" for hybridization refer to conditions under which a nucleic acid having complementarity to a target sequence predominantly hybridizes with the target sequence, and substantially does not hybridize to non-target sequences. Stringent conditions are generally sequence-dependent, and vary depending on a number of factors. In general, the longer the sequence, the higher the temperature at which the sequence specifically hybridizes to its target sequence. Non-limiting examples of stringent conditions are described in detail in Tijssen (1993), Laboratory Techniques In Biochemistry And Molecular Biology-Hybridization With Nucleic Acid Probes Part I, Second Chapter "Overview of principles of hybridization and the strategy of nucleic acid probe assay", Elsevier, N.Y. Where reference is made to a polynucleotide sequence, then complementary or partially complementary sequences are also envisaged. These are preferably capable of hybridising to the reference sequence under highly stringent conditions. Generally, in order to maximize the hybridization rate, relatively low-stringency hybridization conditions are selected: about 20 to 25° C. lower than the thermal melting point ($T_m$). The $T_m$ is the temperature at which 50% of a specific target sequence hybridizes to a perfectly complementary probe in solution at a defined ionic strength and pH. Generally, in order to require at least about 85% nucleotide complementarity of hybridized or hybridizable sequences, highly stringent washing conditions are selected to be about 5 to 15° C. lower than the $T_m$. In order to require at least about 70% nucleotide complementarity of hybridized or hybridizable sequences, moderately-stringent washing conditions are selected to be about 15 to 30° C. lower than the $T_m$. Highly permissive (very low stringency) washing conditions may be as low as 50° C. below the $T_m$, allowing a high level of mis-matching between hybridized or hybridizable sequences. Those skilled in the art will recognize that other physical and chemical parameters in the hybridization and wash stages can also be altered to affect the outcome of a detectable hybridization signal from a specific level of homology between target and probe sequences. Preferred highly stringent conditions comprise incubation in 50% formamide, 5×SSC, and 1% SDS at 42° C., or incubation in 5×SSC and 1% SDS at 65° C., with wash in 0.2×SSC and 0.1% SDS at 65° C.

"Hybridization" refers to a reaction in which one or more polynucleotides react to form a complex that is stabilized via hydrogen bonding between the bases of the nucleotide residues. The hydrogen bonding may occur by Watson Crick base pairing, Hoogstein binding, or in any other sequence specific manner. The complex may comprise two strands forming a duplex structure, three or more strands forming a multi stranded complex, a single self-hybridizing strand, or any combination of these. A hybridization reaction may constitute a step in a more extensive process, such as the initiation of PCR, or the cleavage of a polynucleotide by an enzyme. A sequence capable of hybridizing with a given sequence is referred to as the "complement" of the given sequence.

As used herein, the term "genomic locus" or "locus" (plural loci) is the specific location of a gene or DNA sequence on a chromosome. A "gene" refers to stretches of DNA or RNA that encode a polypeptide or an RNA chain that has functional role to play in an organism and hence is the molecular unit of heredity in living organisms. For the purpose of this invention it may be considered that genes include regions which regulate the production of the gene product, whether or not such regulatory sequences are adjacent to coding and/or transcribed sequences. Accordingly, a gene includes, but is not necessarily limited to, promoter sequences, terminators, translational regulatory sequences such as ribosome binding sites and internal ribosome entry sites, enhancers, silencers, insulators, boundary elements, replication origins, matrix attachment sites and locus control regions.

As used herein, "expression of a genomic locus" or "gene expression" is the process by which information from a gene is used in the synthesis of a functional gene product. The products of gene expression are often proteins, but in non-protein coding genes such as rRNA genes or tRNA genes, the product is functional RNA. The process of gene expression is used by all known life—eukaryotes (including multicellular organisms), prokaryotes (bacteria and archaea) and viruses to generate functional products to survive. As used herein "expression" of a gene or nucleic acid encompasses not only cellular gene expression, but also the transcription and translation of nucleic acid(s) in cloning systems and in any other context. As used herein, "expression" also refers to the process by which a polynucleotide is transcribed from a DNA template (such as into and mRNA or other RNA transcript) and/or the process by which a transcribed mRNA is subsequently translated into peptides, polypeptides, or proteins. Transcripts and encoded polypeptides may be collectively referred to as "gene product." If the polynucleotide is derived from genomic DNA, expression may include splicing of the mRNA in a eukaryotic cell.

The terms "polypeptide", "peptide" and "protein" are used interchangeably herein to refer to polymers of amino acids of any length. The polymer may be linear or branched, it may comprise modified amino acids, and it may be interrupted by non amino acids. The terms also encompass an amino acid polymer that has been modified; for example, disulfide bond formation, glycosylation, lipidation, acetylation, phosphorylation, or any other manipulation, such as conjugation with a labeling component. As used herein the term "amino acid" includes natural and/or unnatural or synthetic amino acids, including glycine and both the D or L optical isomers, and amino acid analogs and peptidomimetics.

As used herein, the term "domain" or "protein domain" refers to a part of a protein sequence that may exist and function independently of the rest of the protein chain.

As described in aspects of the invention, sequence identity is related to sequence homology. Homology comparisons may be conducted by eye, or more usually, with the aid of readily available sequence comparison programs. These commercially available computer programs may calculate percent (%) homology between two or more sequences and may also calculate the sequence identity shared by two or more amino acid or nucleic acid sequences. In some preferred embodiments, the capping region of the dTALEs described herein have sequences that are at least 95% identical or share identity to the capping region amino acid sequences provided herein.

Sequence homologies may be generated by any of a number of computer programs known in the art, for example BLAST or FASTA, etc. A suitable computer program for carrying out such an alignment is the GCG Wisconsin Bestfit package (University of Wisconsin, U.S.A; Devereux et al., 1984, Nucleic Acids Research 12:387). Examples of other software than may perform sequence comparisons include, but are not limited to, the BLAST package (see Ausubel et al., 1999 ibid—Chapter 18), FASTA (Atschul et al., 1990, J. Mol. Biol., 403-410) and the GENEWORKS suite of comparison tools. Both BLAST and FASTA are available for offline and online searching (see Ausubel et al., 1999 ibid, pages 7-58 to 7-60). However it is preferred to use the GCG Bestfit program.

Percentage (%) sequence homology may be calculated over contiguous sequences, i.e., one sequence is aligned with the other sequence and each amino acid or nucleotide in one sequence is directly compared with the corresponding amino acid or nucleotide in the other sequence, one residue at a time. This is called an "ungapped" alignment. Typically, such ungapped alignments are performed only over a relatively short number of residues.

Although this is a very simple and consistent method, it fails to take into consideration that, for example, in an otherwise identical pair of sequences, one insertion or deletion may cause the following amino acid residues to be put out of alignment, thus potentially resulting in a large reduction in % homology when a global alignment is performed. Consequently, most sequence comparison methods are designed to produce optimal alignments that take into consideration possible insertions and deletions without unduly penalizing the overall homology or identity score. This is achieved by inserting "gaps" in the sequence alignment to try to maximize local homology or identity.

However, these more complex methods assign "gap penalties" to each gap that occurs in the alignment so that, for the same number of identical amino acids, a sequence alignment with as few gaps as possible—reflecting higher relatedness between the two compared sequences—may achieve a higher score than one with many gaps. "Affinity gap costs" are typically used that charge a relatively high cost for the existence of a gap and a smaller penalty for each subsequent residue in the gap. This is the most commonly used gap scoring system. High gap penalties may, of course, produce optimized alignments with fewer gaps. Most alignment programs allow the gap penalties to be modified. However, it is preferred to use the default values when using such software for sequence comparisons. For example, when using the GCG Wisconsin Bestfit package the default gap penalty for amino acid sequences is −12 for a gap and −4 for each extension.

Calculation of maximum % homology therefore first requires the production of an optimal alignment, taking into consideration gap penalties. A suitable computer program for carrying out such an alignment is the GCG Wisconsin Bestfit package (Devereux et al., 1984 Nuc. Acids Research 12 p387). Examples of other software than may perform sequence comparisons include, but are not limited to, the BLAST package (see Ausubel et al., 1999 Short Protocols in Molecular Biology, 4$^{th}$ Ed.—Chapter 18), FASTA (Altschul et al., 1990 J. Mol. Biol. 403-410) and the GENEWORKS suite of comparison tools. Both BLAST and FASTA are available for offline and online searching (see Ausubel et al., 1999, Short Protocols in Molecular Biology, pages 7-58 to 7-60). However, for some applications, it is preferred to use the GCG Bestfit program. A new tool, called BLAST 2 Sequences is also available for comparing protein and nucleotide sequences (see FEMS Microbiol Lett. 1999 174 (2): 247-50; FEMS Microbiol Lett. 1999 177(1): 187-8 and the website of the National Center for Biotechnology information at the website of the National Institutes for Health).

Although the final % homology may be measured in terms of identity, the alignment process itself is typically not based on an all-or-nothing pair comparison. Instead, a scaled similarity score matrix is generally used that assigns scores to each pair-wise comparison based on chemical similarity or evolutionary distance. An example of such a matrix commonly used is the BLOSUM62 matrix—the default matrix for the BLAST suite of programs. GCG Wisconsin programs generally use either the public default values or a custom symbol comparison table, if supplied (see user manual for further details). For some applications, it is preferred to use the public default values for the GCG package, or in the case of other software, the default matrix, such as BLOSUM62.

Alternatively, percentage homologies may be calculated using the multiple alignment feature in DNASIS™ (Hitachi Software), based on an algorithm, analogous to CLUSTAL (Higgins D G & Sharp P M (1988), Gene 73(1), 237-244). Once the software has produced an optimal alignment, it is possible to calculate % homology, preferably % sequence identity. The software typically does this as part of the sequence comparison and generates a numerical result.

The sequences may also have deletions, insertions or substitutions of amino acid residues which produce a silent change and result in a functionally equivalent substance. Deliberate amino acid substitutions may be made on the basis of similarity in amino acid properties (such as polarity, charge, solubility, hydrophobicity, hydrophilicity, and/or the amphipathic nature of the residues) and it is therefore useful to group amino acids together in functional groups. Amino acids may be grouped together based on the properties of their side chains alone. However, it is more useful to include mutation data as well. The sets of amino acids thus derived are likely to be conserved for structural reasons. These sets may be described in the form of a Venn diagram (Livingstone C. D. and Barton G. J. (1993) "Protein sequence alignments: a strategy for the hierarchical analysis of residue conservation" Comput. Appl. Biosci. 9: 745-756) (Taylor W. R. (1986) "The classification of amino acid conservation" J. Theor. Biol. 119; 205-218). Conservative substitutions may be made, for example according to the table below which describes a generally accepted Venn diagram grouping of amino acids.

TABLE 4

| Set | | Sub-set | |
|---|---|---|---|
| Hydrophobic | F W Y H K M I L V A G C | Aromatic<br>Aliphatic | F W Y H<br>I L V |
| Polar | W Y H K R E D C S T N Q | Charged<br>Positively charged<br>Negatively charged | H K R E D<br>H K R<br>E D |

TABLE 4-continued

| Set | | Sub-set | |
|---|---|---|---|
| Small | V C A G S P T N D | Tiny | A G S |

Embodiments of the invention include sequences (both polynucleotide or polypeptide) which may comprise homologous substitution (substitution and replacement are both used herein to mean the interchange of an existing amino acid residue or nucleotide, with an alternative residue or nucleotide) that may occur i.e., like-for-like substitution in the case of amino acids such as basic for basic, acidic for acidic, polar for polar, etc. Non-homologous substitution may also occur i.e., from one class of residue to another or alternatively involving the inclusion of unnatural amino acids such as ornithine (hereinafter referred to as Z), diaminobutyric acid ornithine (hereinafter referred to as B), norleucine ornithine (hereinafter referred to as O), pyriyl-alanine, thienylalanine, naphthylalanine and phenylglycine.

Variant amino acid sequences may include suitable spacer groups that may be inserted between any two amino acid residues of the sequence including alkyl groups such as methyl, ethyl or propyl groups in addition to amino acid spacers such as glycine or β-alanine residues. A further form of variation, which involves the presence of one or more amino acid residues in peptoid form, may be well understood by those skilled in the art. For the avoidance of doubt, "the peptoid form" is used to refer to variant amino acid residues wherein the α-carbon substituent group is on the residue's nitrogen atom rather than the α-carbon. Processes for preparing peptides in the peptoid form are known in the art, for example Simon R J et al., *PNAS* (1992) 89(20), 9367-9371 and Horwell D C, *Trends Biotechnol.* (1995) 13(4), 132-134.

The practice of the present invention employs, unless otherwise indicated, conventional techniques of immunology, biochemistry, chemistry, molecular biology, microbiology, cell biology, genomics and recombinant DNA, which are within the skill of the art. See Sambrook, Fritsch and Maniatis, MOLECULAR CLONING: A LABORATORY MANUAL, 2nd edition (1989); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)), Harlow and Lane, eds. (1988) ANTIBODIES, A LABORATORY MANUAL, and ANIMAL CELL CULTURE (R.I. Freshney, ed. (1987)).

Vectors

In one aspect, the invention provides for vectors that are used in the engineering and optimization of CRISPR-Cas systems. A used herein, a "vector" is a tool that allows or facilitates the transfer of an entity from one environment to another. It is a replicon, such as a plasmid, phage, or cosmid, into which another DNA segment may be inserted so as to bring about the replication of the inserted segment. Generally, a vector is capable of replication when associated with the proper control elements. In general, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g. circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g. retroviruses, replication defective retroviruses, adenoviruses, replication defective adenoviruses, and adeno-associated viruses (AAVs)). Viral vectors also include polynucleotides carried by a virus for transfection into a host cell. Certain vectors are capable of autonomous replication in a host cell into which they are introduced (e.g. bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g. in an in vitro transcription/translation system or in a host cell when the vector is introduced into the host cell). With regards to recombination and cloning methods, mention is made of U.S. patent application Ser. No. 10/815,730, published Sep. 2, 2004 as US 2004-0171156 A1, the contents of which are herein incorporated by reference in their entirety.

Aspects of the invention relate to bicistronic vectors for chimeric RNA and Cas9. Bicistronic expression vectors for chimeric RNA and Cas9 are preferred. In general and particularly in this embodiment Cas9 is preferably driven by the CBh promoter. The chimeric RNA may preferably be driven by a U6 promoter. Ideally the two are combined. The chimeric guide RNA typically consists of a 20 bp guide sequence (Ns) and this may be joined to the tracr sequence (running from the first "U" of the lower strand to the end of the transcript). The tracr sequence may be truncated at various positions as indicated. The guide and tracr sequences are separated by the tracr-mate sequence, which may be GUUUUAGAGCUA (SEQ ID NO: 92). This may be followed by the loop sequence GAAA as shown. Both of these are preferred examples. Applicants have demonstrated Cas9-mediated indels at the human EMX1 and PVALB loci by SURVEYOR assays. ChiRNAs are indicated by their "+n" designation, and crRNA refers to a hybrid RNA where guide and tracr sequences are expressed as separate transcripts. Throughout this application, chimeric RNA may also be called single guide, or synthetic guide RNA (sgRNA). The loop is preferably GAAA, but it is not limited to this sequence or indeed to being only 4 bp in length. Indeed, preferred loop forming sequences for use in hairpin structures are four nucleotides in length, and most preferably have the sequence GAAA. However, longer or shorter loop sequences may be used, as may alternative sequences. The sequences preferably include a nucleotide triplet (for example, AAA), and an additional nucleotide (for example C or G). Examples of loop forming sequences include CAAA and AAAG.

The term "regulatory element" is intended to include promoters, enhancers, internal ribosomal entry sites (IRES), and other expression control elements (e.g. transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g. liver, pancreas), or particular cell types (e.g. lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g. 1, 2, 3, 4, 5, or more pol III promoters), one or more pol II promoters (e.g. 1, 2, 3, 4, 5, or more pol II promoters), one or more pol I promoters (e.g. 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase (although any suitable DNA-dependent RNA polymerase can be used, such as SP6, T3 or T7). Amplification by T7 RNA polymerase requires the presence of suitable promoters in the RNA-coding DNA. Sequence requirements for polymerase binding sites are well known in the art. Various T7 RNA polymerase promoter sequences are known, including natural sequences and artificial ones. Different T7 RNA polymerases can have different promoter sequence preferences, and mutant T7 RNA polymerases have been produced to match specific promoters (e.g. see U.S. Pat. Nos. 5,122,457 and 5,385,834), but the skilled person can routinely obtain both T7 RNA polymerases and promoter sequences, and can easily match any particular T7 RNA polymerase to its preferred promoter sequence. The consensus 23 base-pair T7 DNA promoter is classically divided into two domains, an upstream binding domain (−17 to −5, numbered relative to the start of transcription), and a downstream initiation domain (−4 to +6). One strand of this 23mer is 5'-TAATACGACTCAC-TATAGGGAGA-3' (SEQ ID NO: 93). The minimum sequence required for efficient transcription is the first 19mer of this 23mer.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escherichia coli* with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. *Gene* 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein.

Examples of suitable inducible non-fusion *E. coli* expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89).

In some embodiments, a vector is a yeast expression vector. Examples of vectors for expression in yeast *Saccharomyces cerivisae* include pYepSec1 (Baldari, et al., 1987. EMBO J. 6: 229-234), pMFa (Kuijan and Herskowitz, 1982. Cell 30: 933-943), pJRY88 (Schultz et al., 1987. Gene 54:

113-123), pYES2 (Invitrogen Corporation, San Diego, Calif), and picZ (InVitrogen Corp, San Diego, Calif.).

In some embodiments, a vector drives protein expression in insect cells using baculovirus expression vectors. Baculovirus vectors available for expression of proteins in cultured insect cells (e.g., SF9 cells) include the pAc series (Smith, et al., 1983. Mol. Cell. Biol. 3: 2156-2165) and the pVL series (Lucklow and Summers, 1989. Virology 170: 31-39).

In some embodiments, a vector is capable of driving expression of one or more sequences in mammalian cells using a mammalian expression vector. Examples of mammalian expression vectors include pCDM8 (Seed, 1987. Nature 329: 840) and pMT2PC (Kaufman, et al., 1987. EMBO J. 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the α-fetoprotein promoter (Campes and Tilghman, 1989. Genes Dev. 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety.

Regulatory Elements

In some embodiments, a regulatory element is operably linked to one or more elements of a CRISPR system so as to drive expression of the one or more elements of the CRISPR system. In general, CRISPRs (Clustered Regularly Interspaced Short Palindromic Repeats), also known as SPIDRs (SPacer Interspersed Direct Repeats), constitute a family of DNA loci that are usually specific to a particular bacterial species. The CRISPR locus comprises a distinct class of interspersed short sequence repeats (SSRs) that were recognized in E. coli (Ishino et al., J. Bacteriol., 169:5429-5433 [1987]; and Nakata et al., J. Bacteriol., 171:3553-3556 [1989]), and associated genes. Similar interspersed SSRs have been identified in Haloferax mediterranei, Streptococcus pyogenes, Anabaena, and Mycobacterium tuberculosis (See, Groenen et al., Mol. Microbiol., 10:1057-1065 [1993]; Hoe et al., Emerg. Infect. Dis., 5:254-263 [1999]; Masepohl et al., Biochim. Biophys. Acta 1307:26-30 [1996]; and Mojica et al., Mol. Microbiol., 17:85-93 [1995]). The CRISPR loci typically differ from other SSRs by the structure of the repeats, which have been termed short regularly spaced repeats (SRSRs) (Janssen et al., OMICS J. Integ. Biol., 6:23-33 [2002]; and Mojica et al., Mol. Microbiol., 36:244-246 [2000]). In general, the repeats are short elements that occur in clusters that are regularly spaced by unique intervening sequences with a substantially constant length (Mojica et al., [2000], supra). Although the repeat sequences are highly conserved between strains, the number of interspersed repeats and the sequences of the spacer regions typically differ from strain to strain (van Embden et al., J. Bacteriol., 182:2393-2401 [2000]). CRISPR loci have been identified in more than 40 prokaryotes (See e.g., Jansen et al., Mol. Microbiol., 43:1565-1575 [2002]; and Mojica et al., [2005]) including, but not limited to Aeropyrum, Pyrobaculum, Sulfolobus, Archaeoglobus, Halocarcula, Methanobacterium, Methanococcus, Methanosarcina, Methanopyrus, Pyrococcus, Picrophilus, Thermoplasma, Corynebacterium, Mycobacterium, Streptomyces, Aquifex, Porphyromonas, Chlorobium, Thermus, Bacillus, Listeria, Staphylococcus, Clostridium, Thermoanaerobacter, Mycoplasma, Fusobacterium, Azarcus, Chromobacterium, Neisseria, Nitrosomonas, Desulfovibrio, Geobacter, Myxococcus, Campylobacter, Wolinella, Acinetobacter, Erwinia, Escherichia, Legionella, Methylococcus, Pasteurella, Photobacterium, Salmonella, Xanthomonas, Yersinia, Treponema, and Thermotoga.

In general, "CRISPR system" refers collectively to transcripts and other elements involved in the expression of or directing the activity of CRISPR-associated ("Cas") genes, including sequences encoding a Cas gene, a tracr (trans-activating CRISPR) sequence (e.g. tracrRNA or an active partial tracrRNA), a tracr-mate sequence (encompassing a "direct repeat" and a tracrRNA-processed partial direct repeat in the context of an endogenous CRISPR system), a guide sequence (also referred to as a "spacer" in the context of an endogenous CRISPR system), or other sequences and transcripts from a CRISPR locus. In embodiments of the invention the terms guide sequence and guide RNA are used interchangeably. In some embodiments, one or more elements of a CRISPR system is derived from a type I, type II, or type III CRISPR system. In some embodiments, one or more elements of a CRISPR system is derived from a particular organism comprising an endogenous CRISPR system, such as Streptococcus pyogenes. In general, a CRISPR system is characterized by elements that promote the formation of a CRISPR complex at the site of a target sequence (also referred to as a protospacer in the context of an endogenous CRISPR system). In the context of formation of a CRISPR complex, "target sequence" refers to a sequence to which a guide sequence is designed to have complementarity, where hybridization between a target sequence and a guide sequence promotes the formation of a CRISPR complex. A target sequence may comprise any polynucleotide, such as DNA or RNA polynucleotides. In some embodiments, a target sequence is located in the nucleus or cytoplasm of a cell.

In some embodiments, direct repeats may be identified in silico by searching for repetitive motifs that fulfill any or all of the following criteria: 1. found in a 2 Kb window of genomic sequence flanking the type II CRISPR locus; 2. span from 20 to 50 bp; and 3. interspaced by 20 to 50 bp. In some embodiments, 2 of these criteria may be used, for instance 1 and 2, 2 and 3, or 1 and 3. In some embodiments, all 3 criteria may be used. In some embodiments, candidate tracrRNA may be subsequently predicted by sequences that fulfill any or all of the following criteria: 1. sequence homology to direct repeats (motif search in Geneious with up to 18-bp mismatches); 2. presence of a predicted Rho-independent transcriptional terminator in direction of transcription; and 3. stable hairpin secondary structure between tracrRNA and direct repeat. In some embodiments, 2 of these criteria may be used, for instance 1 and 2, 2 and 3, or 1 and 3. In some embodiments, all 3 criteria may be used. In some embodiments, chimeric synthetic guide RNAs (sgRNAs) designs may incorporate at least 12 bp of duplex structure between the direct repeat and tracrRNA. In preferred embodiments of the invention, the CRISPR system is a type II CRISPR system and the Cas enzyme is Cas9, which catalyzes DNA cleavage. Enzymatic action by Cas9 derived from *Streptococcus pyogenes* or any closely related Cas9 generates double stranded breaks at target site sequences which hybridize to 20 nucleotides of the guide sequence and that have a protospacer-adjacent motif (PAM) sequence (examples include NGG/NRG or a PAM that can be determined as described herein) following the 20 nucleotides of the target sequence. CRISPR activity through Cas9 for site-specific DNA recognition and cleavage is defined by the guide sequence, the tracr sequence that hybridizes in part to the guide sequence and the PAM sequence. More aspects of the CRISPR system are described in Karginov and Hannon, The CRISPR system: small RNA-guided defence in bacteria and archaea, Mole Cell 2010, January 15; 37(1): 7.

Figure 2A:
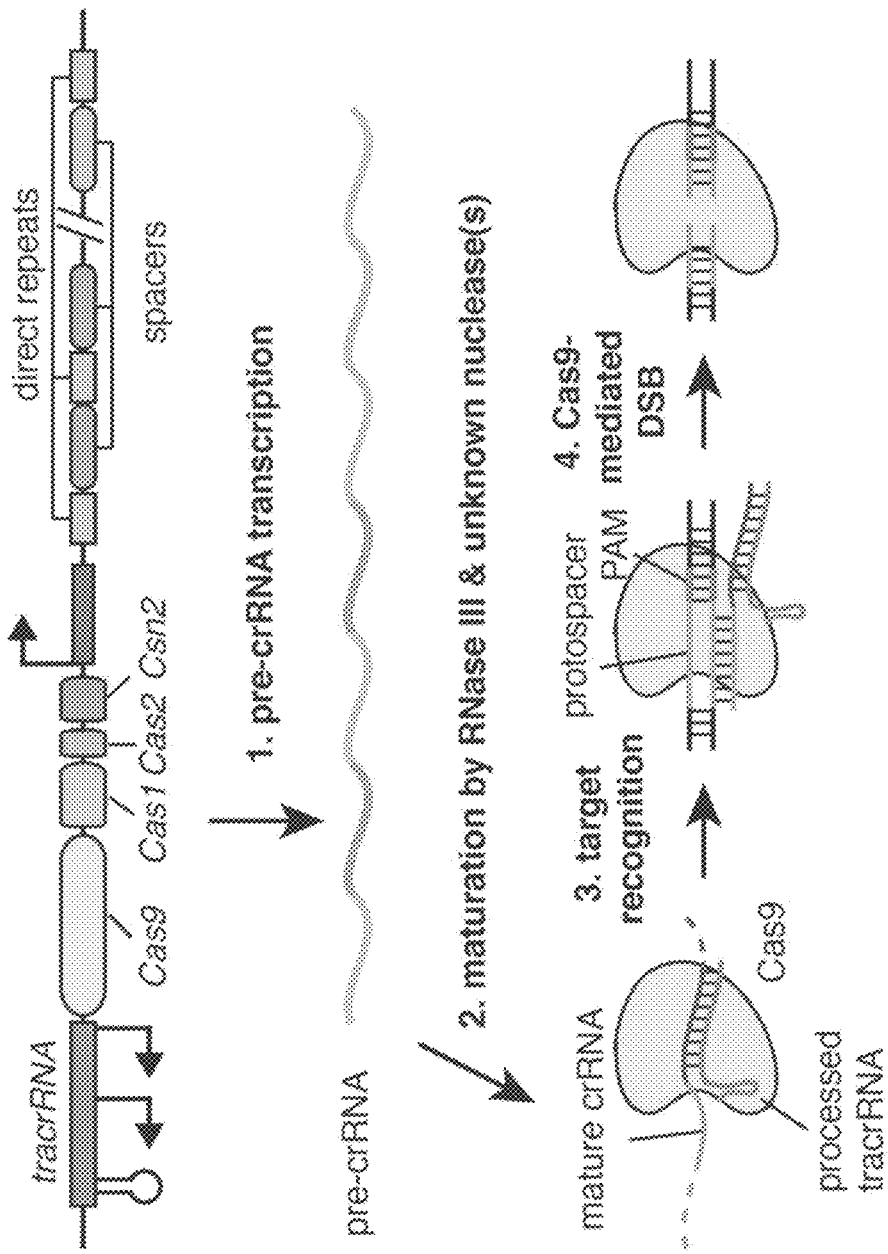
Figure 2C:
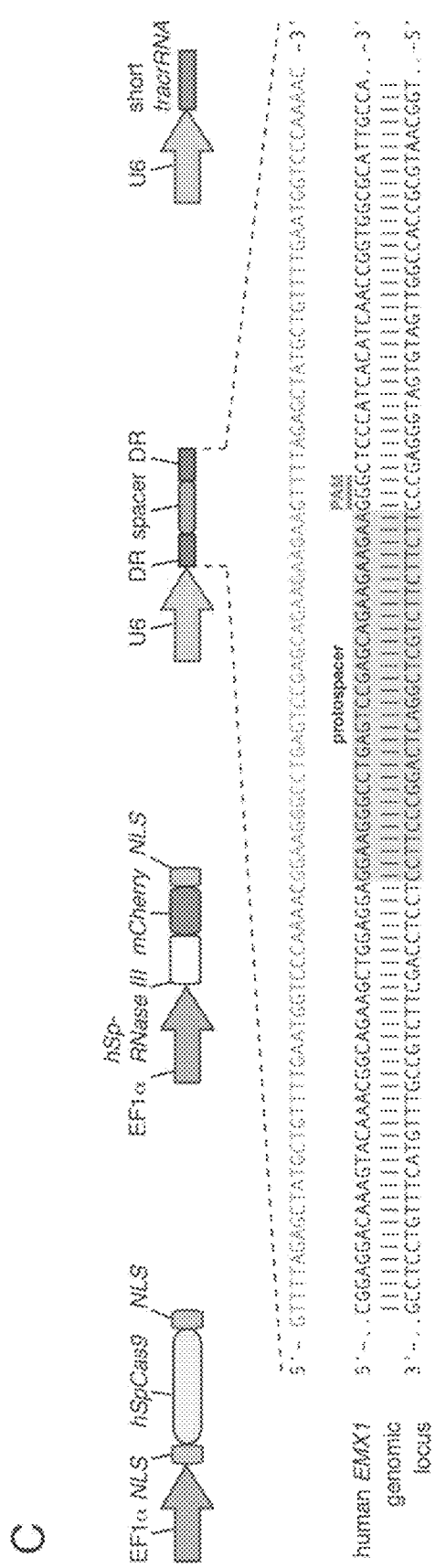

The type II CRISPR locus from *Streptococcus pyogenes* SF370, which contains a cluster of four genes Cas9, Cas1, Cas2, and Csn1, as well as two non-coding RNA elements, tracrRNA and a characteristic array of repetitive sequences (direct repeats) interspaced by short stretches of non-repetitive sequences (spacers, about 30 bp each). In this system, targeted DNA double-strand break (DSB) is generated in four sequential steps (FIG. 2A). First, two non-coding RNAs, the pre-crRNA array and tracrRNA, are transcribed from the CRISPR locus. Second, tracrRNA hybridizes to the direct repeats of pre-crRNA, which is then processed into mature crRNAs containing individual spacer sequences. Third, the mature crRNA:tracrRNA complex directs Cas9 to the DNA target consisting of the protospacer and the corresponding PAM via heteroduplex formation between the spacer region of the crRNA and the protospacer DNA. Finally, Cas9 mediates cleavage of target DNA upstream of PAM to create a DSB within the protospacer (FIG. 2A). FIG. 2B demonstrates the nuclear localization of the codon optimized Cas9. To promote precise transcriptional initiation, the RNA polymerase III-based U6 promoter was selected to drive the expression of tracrRNA (FIG. 2C). Similarly, a U6 promoter-based construct was developed to express a pre-crRNA array consisting of a single spacer flanked by two direct repeats (DRs, also encompassed by the term "tracr-mate sequences"; FIG. 2C). The initial spacer was designed to target a 33-base-pair (bp) target site (30-bp protospacer plus a 3-bp CRISPR motif (PAM) sequence satisfying the NGG recognition motif of Cas9) in the human EMX1 locus (FIG. 2C), a key gene in the development of the cerebral cortex.

Typically, in the context of an endogenous CRISPR system, formation of a CRISPR complex (comprising a guide sequence hybridized or hybridizable to a target sequence and complexed with one or more Cas proteins) results in cleavage of one or both strands in or near (e.g. within 1, 2, 3, 4, 5, 6, 7, 8, 9, 10, 20, 50, or more base pairs from) the target sequence. Without wishing to be bound by theory, the tracr sequence, which may comprise or consist of all or a portion of a wild-type tracr sequence (e.g. about or more than about 20, 26, 32, 45, 48, 54, 63, 67, 85, or more nucleotides of a wild-type tracr sequence), may also form part of a CRISPR complex, such as by hybridization along at least a portion of the tracr sequence to all or a portion of a tracr mate sequence that is operably linked to the guide sequence. In some embodiments, one or more vectors driving expression of one or more elements of a CRISPR system are introduced into a host cell such that expression of the elements of the CRISPR system direct formation of a CRISPR complex at one or more target sites. For example, a Cas enzyme, a guide sequence linked to a tracr-mate sequence, and a tracr sequence could each be operably linked to separate regulatory elements on separate vectors. Alternatively, two or more of the elements expressed from the same or different regulatory elements, may be combined in a single vector, with one or more additional vectors providing any components of the CRISPR system not included in the first vector. CRISPR system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a CRISPR enzyme and one or more of the guide sequence, tracr mate sequence (optionally operably linked to the guide sequence), and a tracr sequence embedded within one or more intron sequences (e.g. each in a different intron, two or more in at least one intron, or all in a single intron). In some embodiments, the CRISPR enzyme, guide sequence, tracr mate sequence, and tracr sequence are operably linked to and expressed from the same promoter.

In some embodiments, a vector comprises one or more insertion sites, such as a restriction endonuclease recognition sequence (also referred to as a "cloning site"). In some embodiments, one or more insertion sites (e.g. about or more than about 1, 2, 3, 4, 5, 6, 7, 8, 9, 10, or more insertion sites) are located upstream and/or downstream of one or more sequence elements of one or more vectors. In some embodiments, a vector comprises an insertion site upstream of a tracr mate sequence, and optionally downstream of a regulatory element operably linked to the tracr mate sequence, such that following insertion of a guide sequence into the insertion site and upon expression the guide sequence directs sequence-specific binding of a CRISPR complex to a target sequence in a eukaryotic cell. In some embodiments, a vector comprises two or more insertion sites, each insertion site being located between two tracr mate sequences so as to allow insertion of a guide sequence at each site. In such an arrangement, the two or more guide sequences may comprise two or more copies of a single guide sequence, two or more different guide sequences, or combinations of these. When multiple different guide sequences are used, a single expression construct may be used to target CRISPR activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide-sequence-containing vectors may be provided, and optionally delivered to a cell.

In some embodiments, a vector comprises a regulatory element operably linked to an enzyme-coding sequence encoding a CRISPR enzyme, such as a Cas protein. Non-limiting examples of Cas proteins include Cas1, Cas1B, Cas2, Cas3, Cas4, Cas5, Cas6, Cas7, Cas8, Cas9 (also known as Csn1 and Csx12), Cas10, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, homologues thereof, or modified versions thereof. In some embodiments, the unmodified CRISPR enzyme has DNA cleavage activity, such as Cas9. In some embodiments, the CRISPR enzyme directs cleavage of one or both strands at the location of a target sequence, such as within the target sequence and/or within the complement of the target sequence. In some embodiments, the CRISPR enzyme directs cleavage of one or both strands within about 1, 2, 3, 4, 5, 6, 7, 8, 9, 10, 15, 20, 25, 50, 100, 200, 500, or more base pairs from the first or last nucleotide of a target sequence. In some embodiments, a vector encodes a CRISPR enzyme that is mutated to with respect to a corresponding wild-type enzyme such that the mutated CRISPR enzyme lacks the ability to cleave one or both strands of a target polynucleotide containing a target sequence. For example, an aspartate-to-alanine substitution (D10A) in the RuvC I catalytic domain of Cas9 from *S. pyogenes* converts Cas9 from a nuclease that cleaves both strands to a nickase (cleaves a single strand). Other examples of mutations that render Cas9 a nickase include, without limitation, H840A, N854A, and N863A. As a further example, two or more catalytic domains of Cas9 (RuvC I, RuvC II, and RuvC III or the HNH domain) may be mutated to produce a mutated Cas9 substantially lacking all DNA cleavage activity. In some embodiments, a D10A mutation is combined with one or more of H840A, N854A, or N863A mutations to produce a Cas9 enzyme substantially lacking all DNA cleavage activity. In some embodiments, a CRISPR enzyme is considered to substantially lack all DNA cleavage activity when the DNA cleavage activity of the mutated enzyme is less than about 25%, 10%, 5%, 1%, 0.1%, 0.01%, or lower with respect to its non-mutated form. Where the enzyme is not SpCas9, mutations may be made at any or all residues corresponding to positions 10, 762, 840, 854, 863 and/or 986 of SpCas9 (which may be ascertained for instance by standard sequence comparison tools. In particular, any or all of the following mutations are preferred in SpCas9: D10A, E762A, H840A, N854A, N863A and/or D986A; as well as conservative substitution for any of the replacement amino acids is also envisaged. The same (or conservative substitutions of these mutations) at corresponding positions in other Cas9s are also preferred. Particularly preferred are D10 and H840 in SpCas9. However, in other Cas9s, residues corresponding to SpCas9 D10 and H840 are also preferred.

An aspartate-to-alanine substitution (D10A) in the RuvC I catalytic domain of SpCas9 was engineered to convert the nuclease into a nickase (SpCas9n) (see e.g. Sapranauskas et al., 2011, Nucleic Acis Research, 39: 9275; Gasiunas et al., 2012, Proc. Natl. Acad. Sci. USA, 109:E2579), such that nicked genomic DNA undergoes the high-fidelity homology-directed repair (HDR). Surveyor assay confirmed that SpCas9n does not generate indels at the EMX1 protospacer target. Co-expression of EMX1-targeting chimeric crRNA (having the tracrRNA component as well) with SpCas9 produced indels in the target site, whereas co-expression with SpCas9n did not (n=3). Moreover, sequencing of 327 amplicons did not detect any indels induced by SpCas9n. The same locus was selected to test CRISPR-mediated HR by co-transfecting HEK 293FT cells with the chimeric RNA targeting EMX1, hSpCas9 or hSpCas9n, as well as a HR template to introduce a pair of restriction sites (HindIII and NheI) near the protospacer.

Preferred orthologs are described herein. A Cas enzyme may be identified Cas9 as this can refer to the general class of enzymes that share homology to the biggest nuclease with multiple nuclease domains from the type II CRISPR system. Most preferably, the Cas9 enzyme is from, or is derived from, spCas9 or saCas9. By derived, Applicants mean that the derived enzyme is largely based, in the sense of having a high degree of sequence homology with, a wildtype enzyme, but that it has been mutated (modified) in some way as described herein.

It will be appreciated that the terms Cas and CRISPR enzyme are generally used herein interchangeably, unless otherwise apparent. As mentioned above, many of the residue numberings used herein refer to the Cas9 enzyme from the type II CRISPR locus in *Streptococcus pyogenes*. However, it will be appreciated that this invention includes many more Cas9s from other species of microbes, such as SpCas9, SaCa9, St1Cas9 and so forth.

Codon Optimization

An example of a codon optimized sequence, in this instance optimized for humans (i.e. being optimized for expression in humans) is provided herein, see the SaCas9 human codon optimized sequence. Whilst this is preferred, it will be appreciated that other examples are possible and codon optimization for a host species is known. In some embodiments, an enzyme coding sequence encoding a CRISPR enzyme is codon optimized for expression in particular cells, such as eukaryotic cells. The eukaryotic cells may be those of or derived from a particular organism, such as a mammal, including but not limited to human, mouse, rat, rabbit, dog, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/(visited Jul. 9, 2002), and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g. 1, 2, 3, 4, 5, 10, 15, 20, 25, 50, or more, or all codons) in a sequence encoding a CRISPR enzyme correspond to the most frequently used codon for a particular amino acid.

Codon usage can even be optimized for expression in particular cell types e.g. for brain cells. For instance, Plotkin et al. (2004) PNAS USA 101:12588-91 reports on tissue-specific codon usage and notes, for instance, that brain-specific genes show a characteristically different codon usage than liver-specific genes. Thus a protein-coding sequence can be codon-optimised for expression in a target cell type of interest e.g. for expression in the liver.

Nuclear Localization Sequences (NLSs)

In some embodiments, a vector encodes a CRISPR enzyme comprising one or more nuclear localization sequences (NLSs), such as about or more than about 1, 2, 3, 4, 5, 6, 7, 8, 9, 10, or more NLSs. In some embodiments, the CRISPR enzyme comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g. one or more NLS at the amino-terminus and one or more NLS at the carboxy terminus). When more than one NLS is present, each may be selected independently of the others, such that a single NLS may be present in more than one copy and/or in combination with one or more other NLSs present in one or more copies. In a preferred embodiment of the invention, the CRISPR enzyme comprises at most 6 NLSs. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. Non-limiting examples of NLSs include an NLS sequence derived from: the NLS of the SV40 virus large T-antigen, having the amino acid sequence PKKKRKV (SEQ ID NO: 22); the NLS from nucleoplasmin (e.g. the nucleoplasmin bipartite NLS with the sequence KRPAATKKAGQAKKKK (SEQ ID NO: 23)); the c-myc NLS having the amino acid sequence PAAKRVKLD (SEQ ID NO: 24) or RQRRNELKRSP (SEQ ID NO: 25); the hRNPA1 M9 NLS having the sequence NQSSNFGPMKGGNFGGRSSGPYGGGGQYFAK-PRNQGGY (SEQ ID NO: 26); the sequence RMRIZFKNKGKDTAELRRRRVEVSVELRKAKKD-EQILKRRNV (SEQ ID NO: 27) of the IBB domain from importin-alpha; the sequences VSRKRPRP (SEQ ID NO: 28) and PPKKARED (SEQ ID NO: 29) of the myoma T protein; the sequence PQPKKKPL (SEQ ID NO: 30) of human p53; the sequence SALIKKKKKMAP (SEQ ID NO: 31) of mouse c-ab1 IV; the sequences DRLRR (SEQ ID NO: 32) and PKQKKRK (SEQ ID NO: 33) of the influenza virus NS1; the sequence RKLKKKIKKL (SEQ ID NO: 34) of the Hepatitis virus delta antigen; the sequence REKKKFLKRR (SEQ ID NO: 35) of the mouse Mx1 protein; the sequence KRKGDEVDGVDEVAKKKSKK (SEQ ID NO: 36) of the human poly(ADP-ribose) polymerase; and the sequence RKCLQAGMNLEARKTKK (SEQ ID NO: 37) of the steroid hormone receptors (human) glucocorticoid.

In general, the one or more NLSs are of sufficient strength to drive accumulation of the CRISPR enzyme in a detectable amount in the nucleus of a eukaryotic cell. In general, strength of nuclear localization activity may derive from the number of NLSs in the CRISPR enzyme, the particular NLS(s) used, or a combination of these factors. Detection of accumulation in the nucleus may be performed by any suitable technique. For example, a detectable marker may be fused to the CRISPR enzyme, such that location within a cell may be visualized, such as in combination with a means for detecting the location of the nucleus (e.g. a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of CRISPR complex formation (e.g. assay for DNA cleavage or mutation at the target sequence, or assay for altered gene expression activity affected by CRISPR complex formation and/or CRISPR enzyme activity), as compared to a control no exposed to the CRISPR enzyme or complex, or exposed to a CRISPR enzyme lacking the one or more NLSs.

Guide Sequence

In general, a guide sequence is any polynucleotide sequence having sufficient complementarity with a target polynucleotide sequence to hybridize with the target sequence and direct sequence-specific binding of a CRISPR complex to the target sequence. In some embodiments, the degree of complementarity between a guide sequence and its corresponding target sequence, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g. the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20, 15, 12, or fewer nucleotides in length. The ability of a guide sequence to direct sequence-specific binding of a CRISPR complex to a target sequence may be assessed by any suitable assay. For example, the components of a CRISPR system sufficient to form a CRISPR complex, including the guide sequence to be tested, may be provided to a host cell having the corresponding target sequence, such as by transfection with vectors encoding the components of the CRISPR sequence, followed by an assessment of preferential cleavage within the target sequence, such as by Surveyor assay as described herein. Similarly, cleavage of a target polynucleotide sequence may be evaluated in a test tube by providing the target sequence, components of a CRISPR complex, including the guide sequence to be tested and a control guide sequence different from the test guide sequence, and comparing binding or rate of cleavage at the target sequence between the test and control guide sequence reactions. Other assays are possible, and will occur to those skilled in the art.

A guide sequence may be selected to target any target sequence. In some embodiments, the target sequence is a sequence within a genome of a cell. Exemplary target sequences include those that are unique in the target genome. For example, for the *S. pyogenes* Cas9, a unique target sequence in a genome may include a Cas9 target site of the form MMMMMMMMNNNNNNNNNNNNXGG (SEQ ID NO: 1) where NNNNNNNNNNNNXGG (SEQ ID NO: 2) (N is A, G, T, or C; and X can be anything) has a single occurrence in the genome. A unique target sequence in a genome may include an *S. pyogenes* Cas9 target site of the form MMMMMMMMMNNNNNNNNNNNXGG (SEQ ID NO: 3) where NNNNNNNNNNNXGG (SEQ ID NO: 4) (N is A, G, T, or C; and X can be anything) has a single occurrence in the genome. For the *S. thermophilus* CRISPR1 Cas9, a unique target sequence in a genome may include a Cas9 target site of the form MMMMMMMMMNNNNNNNNNNNXXAGAAW (SEQ ID NO: 5) where NNNNNNNNNNNXXAGAAW (SEQ ID NO: 6) (N is A, G, T, or C; X can be anything; and W is A or T) has a single occurrence in the genome. A unique target sequence in a genome may include an *S. thermophilus* CRISPR1 Cas9 target site of the form MMMMMMMMMNNNNNNNNNNNXXAGAAW (SEQ ID NO: 7) where NNNNNNNNNNNXXAGAAW (SEQ ID NO: 8) (N is A, G, T, or C; X can be anything; and W is A or T) has a single occurrence in the genome. For the *S. pyogenes* Cas9, a unique target sequence in a genome may include a Cas9 target site of the form MMMMMMMMNNNNNNNNNNNNXGGXG (SEQ ID NO: 9) where NNNNNNNNNNNNXGGXG (SEQ ID NO: 10) (N is A, G, T, or C; and X can be anything) has a single occurrence in the genome. A unique target sequence in a genome may include an *S. pyogenes* Cas9 target site of the form MMMMMMMMMNNNNNNNNNNNXGGXG (SEQ ID NO: 11) where NNNNNNNNNNNXGGXG (SEQ ID NO: 12) (N is A, G, T, or C; and X can be anything) has a single occurrence in the genome. In each of these sequences "M" may be A, G, T, or C, and need not be considered in identifying a sequence as unique. In some embodiments, a guide sequence is selected to reduce the degree secondary structure within the guide sequence. In some embodiments, about or less than about 75%, 50%, 40%, 30%, 25%, 20%, 15%, 10%, 5%, 1%, or fewer of the nucleotides of the guide sequence participate in self-complementary base pairing when optimally folded. Optimal folding may be determined by any suitable polynucleotide-folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g. A. R. Gruber et al., 2008, *Cell* 106(1): 23-24; and P A Carr and GM Church, 2009, Nature Biotechnology 27(12): 1151-62).

Tracr Mate Sequence

In general, a tracr mate sequence includes any sequence that has sufficient complementarity with a tracr sequence to promote one or more of: (1) excision of a guide sequence flanked by tracr mate sequences in a cell containing the corresponding tracr sequence; and (2) formation of a CRISPR complex at a target sequence, wherein the CRISPR complex comprises the tracr mate sequence hybridized or hybridizable to the tracr sequence. In general, degree of complementarity is with reference to the optimal alignment of the tracr mate sequence and tracr sequence, along the length of the shorter of the two sequences. Optimal alignment may be determined by any suitable alignment algorithm, and may further account for secondary structures, such as self-complementarity within either the tracr sequence or tracr mate sequence. In some embodiments, the degree of complementarity between the tracr sequence and tracr mate sequence along the length of the shorter of the two when optimally aligned is about or more than about 25%, 30%, 40%, 50%, 60%, 70%, 80%, 90%, 95%, 97.5%, 99%, or higher. In some embodiments, the tracr sequence is about or more than about 5, 6, 7, 8, 9, 10, 11, 12, 13, 14, 15, 16, 17, 18, 19, 20, 25, 30, 40, 50, or more nucleotides in length. In some embodiments, the tracr sequence and tracr mate sequence are contained within a single transcript, such that hybridization between the two produces a transcript having a secondary structure, such as a hairpin. In an embodiment of the invention, the transcript or transcribed polynucleotide sequence has at least two or more hairpins. In preferred embodiments, the transcript has two, three, four or five hairpins. In a further embodiment of the invention, the transcript has at most five hairpins. In a hairpin structure the portion of the sequence 5' of the final "N" and upstream of the loop corresponds to the tracr mate sequence, and the portion of the sequence 3' of the loop corresponds to the tracr sequence Further non-limiting examples of single polynucleotides comprising a guide sequence, a tracr mate sequence, and a tracr sequence are as follows (listed 5' to 3'), where "N" represents a base of a guide sequence, the first block of lower case letters represent the tracr mate sequence, and the second block of lower case letters represent the tracr sequence, and the final poly-T sequence represents the transcription terminator: (1) NNNNNNNNNNNNNNNNNNNNgttttgtactctcaagatt-taGAAAtaaatcttgcagaagctacaaagataa ggcttcatgccgaaat-caacaccctgtcattttatggcagggtgtttcgttatttaaTTTTTT (SEQ ID NO: 13); (2) NNNNNNNNNNNNNNNNNN NNgttttgtactctcaGAAAtgcagaagctacaaagataaggcttcatgccg aaatcaacaccctgtcattttatggcagggtgtttcgttatttaaTTTTTT (SEQ ID NO: 14); (3) NNNNNNNNNNNNNNNNNN NNgttttgtactctcaGAAAtgcagaagctacaaagataaggcttcatgccg aaatcaacaccctgtcattttatggcagggtgTTTTTT (SEQ ID NO: 15); (4) NNNNNNNNNNNNNNNNNNNNgttt-tagagctaGAAAtagcaagttaaaataaggctagtccgttatcaactt gaaaaagtggcaccgagtcggtgcTTTTTT (SEQ ID NO: 16); (5) NNNNNNNNNNNNNNNNNNNNgttt-tagagctaGAAATAGcaagttaaaataaggctagtccgttatcaac ttgaaaaagtgTTTTTTT (SEQ ID NO: 17); and (6) NNNNNNNNNNNNNNNNNNNNgttt-tagagctagAAATAGcaagttaaaataaggctagtccgttatcaTT TTTTTT (SEQ ID NO: 18). In some embodiments, sequences (1) to (3) are used in combination with Cas9 from *S. thermophilus* CRISPR1. In some embodiments, sequences (4) to (6) are used in combination with Cas9 from *S. pyogenes*. In some embodiments, the tracr sequence is a separate transcript from a transcript comprising the tracr mate sequence.

Recombination Template

In some embodiments, a recombination template is also provided. A recombination template may be a component of another vector as described herein, contained in a separate vector, or provided as a separate polynucleotide. In some embodiments, a recombination template is designed to serve as a template in homologous recombination, such as within or near a target sequence nicked or cleaved by a CRISPR enzyme as a part of a CRISPR complex. A template polynucleotide may be of any suitable length, such as about or more than about 10, 15, 20, 25, 50, 75, 100, 150, 200, 500, 1000, or more nucleotides in length. In some embodiments, the template polynucleotide is complementary to a portion of a polynucleotide comprising the target sequence. When optimally aligned, a template polynucleotide might overlap with one or more nucleotides of a target sequences (e.g. about or more than about 1, 5, 10, 15, 20, or more nucleotides). In some embodiments, when a template sequence and a polynucleotide comprising a target sequence are optimally aligned, the nearest nucleotide of the template polynucleotide is within about 1, 5, 10, 15, 20, 25, 50, 75, 100, 200, 300, 400, 500, 1000, 5000, 10000, or more nucleotides from the target sequence.

Fusion Protein

In some embodiments, the CRISPR enzyme is part of a fusion protein comprising one or more heterologous protein domains (e.g. about or more than about 1, 2, 3, 4, 5, 6, 7, 8, 9, 10, or more domains in addition to the CRISPR enzyme). A CRISPR enzyme fusion protein may comprise any additional protein sequence, and optionally a linker sequence between any two domains. Examples of protein domains that may be fused to a CRISPR enzyme include, without limitation, epitope tags, reporter gene sequences, and protein domains having one or more of the following activities: methylase activity, demethylase activity, transcription activation activity, transcription repression activity, transcription release factor activity, histone modification activity, RNA cleavage activity and nucleic acid binding activity. Non-limiting examples of epitope tags include histidine (His) tags, V5 tags, FLAG tags, influenza hemagglutinin (HA) tags, Myc tags, VSV-G tags, and thioredoxin (Trx) tags. Examples of reporter genes include, but are not limited to, glutathione-S-transferase (GST), horseradish peroxidase (HRP), chloramphenicol acetyltransferase (CAT) beta-galactosidase, beta-glucuronidase, luciferase, green fluorescent protein (GFP), HcRed, DsRed, cyan fluorescent protein (CFP), yellow fluorescent protein (YFP), and autofluorescent proteins including blue fluorescent protein (BFP). A CRISPR enzyme may be fused to a gene sequence encoding a protein or a fragment of a protein that bind DNA molecules or bind other cellular molecules, including but not limited to maltose binding protein (MBP), S-tag, Lex A DNA binding domain (DBD) fusions, GAL4 DNA binding domain fusions, and herpes simplex virus (HSV) BP16 protein fusions. Additional domains that may form part of a fusion protein comprising a CRISPR enzyme are described in US20110059502, incorporated herein by reference. In some embodiments, a tagged CRISPR enzyme is used to identify the location of a target sequence.

Inducible system

In some embodiments, a CRISPR enzyme may form a component of an inducible system. The inducible nature of the system would allow for spatiotemporal control of gene editing or gene expression using a form of energy. The form of energy may include but is not limited to electromagnetic radiation, sound energy, chemical energy and thermal energy. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome).In one embodiment, the CRISPR enzyme may be a part of a Light Inducible Transcriptional Effector (LITE) to direct changes in transcriptional activity in a sequence-specific manner. The components of a light may include a CRISPR enzyme, a light-responsive cytochrome heterodimer (e.g. from *Arabidopsis thaliana*), and a transcriptional activation/repression domain. Further examples of inducible DNA binding proteins and methods for their use are provided in U.S. 61/736,465 and U.S. 61/721,283, which is hereby incorporated by reference in its entirety (see also Konerman et al. (2013) Nature doi: 10.1038/nature12466).

Delivery

In some aspects, the invention provides methods comprising delivering one or more polynucleotides, such as or one or more vectors as described herein, one or more transcripts thereof, and/or one or proteins transcribed therefrom, to a host cell. In some aspects, the invention further provides cells produced by such methods, and animals comprising or produced from such cells. In some embodiments, a CRISPR enzyme in combination with (and optionally complexed with) a guide sequence is delivered to a cell. Conventional viral and non-viral based gene transfer methods can be used to introduce nucleic acids in mammalian cells or target tissues. Such methods can be used to administer nucleic acids encoding components of a CRISPR system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology Doerfler and Bohm (eds) (1995); and Yu et al., Gene Therapy 1:13-26 (1994).

Methods of non-viral delivery of nucleic acids include lipofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787).

The use of RNA or DNA viral based systems for the delivery of nucleic acids take advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59 (1990); Wilson et al., J. Virol. 63:2374-2378 (1989); Miller et al., J. Virol. 65:2220-2224 (1991); WO94/26877).

In another embodiment, Cocal vesiculovirus envelope pseudotyped retroviral vector particles are contemplated (see, e.g., US Patent Publication No. 20120164118 assigned to the Fred Hutchinson Cancer Research Center). Cocal virus is in the Vesiculovirus genus, and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. Within certain aspects of these embodiments, the Gag, Pol, and accessory proteins are lentiviral and/or gammaretroviral.

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system.

Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

Packaging cells are typically used to form virus particles that are capable of infecting a host cell. Such cells include 293 or PER.C6 cells, which package adenovirus, and W2 cells or PA317 cells, which package retrovirus. Viral vectors used in gene therapy are usually generated by producer a cell line that packages a nucleic acid vector into a viral particle. The vectors typically contain the minimal viral sequences required for packaging and subsequent integration into a host, other viral sequences being replaced by an expression cassette for the polynucleotide(s) to be expressed. The missing viral functions are typically supplied in trans by the packaging cell line. For example, AAV vectors used in gene therapy typically only possess ITR sequences from the AAV genome which are required for packaging and integration into the host genome. Viral DNA is packaged in a cell line, which contains a helper plasmid encoding the other AAV genes, namely rep and cap, but lacking ITR sequences. The cell line may also infected with adenovirus as a helper. The helper virus promotes replication of the AAV vector and expression of AAV genes from the helper plasmid. The helper plasmid is not packaged in significant amounts due to a lack of ITR sequences. Contamination with adenovirus can be reduced by, e.g., heat treatment to which adenovirus is more sensitive than AAV. Accordingly, AAV is considered an ideal candidate for use as a transducing vector. Such AAV transducing vectors can comprise sufficient cis-acting functions to replicate in the presence of adenovirus or herpesvirus or poxvirus (e.g., vaccinia virus) helper functions provided in trans. Recombinant AAV (rAAV) can be used to carry exogenous genes into cells of a variety of lineages. In these vectors, the AAV cap and/or rep genes are deleted from the viral genome and replaced with a DNA segment of choice. Current AAV vectors may accommodate up to 4300 bases of inserted DNA.

There are a number of ways to produce rAAV, and the invention provides rAAV and methods for preparing rAAV. For example, plasmid(s) containing or consisting essentially of the desired viral construct are transfected into AAV-infected cells or into a packaging cell. In addition, a second or additional helper plasmid is cotransfected into these cells to provide the AAV rep and/or cap genes which are obligatory for replication and packaging of the recombinant viral construct. Under these conditions, the rep and/or cap proteins of AAV act in trans to stimulate replication and packaging of the rAAV construct. Two to Three days after transfection, rAAV is harvested. Traditionally rAAV is harvested from the cells along with adenovirus. The contaminating adenovirus is then inactivated by heat treatment. In the instant invention, rAAV is advantageously harvested not from the cells themselves, but from cell supernatant. Accordingly, in an initial aspect the invention provides for preparing rAAV, and in addition to the foregoing, rAAV can be prepared by a method that comprises or consists essentially of: infecting susceptible cells with a rAAV containing exogenous DNA including DNA for expression, and helper virus (e.g., adenovirus, herpesvirus, poxvirus such as vaccinia virus) wherein the rAAV lacks functioning cap and/or rep (and the helper virus (e.g., adenovirus, herpesvirus, poxvirus such as vaccinia virus) provides the cap and/or rev function that the rAAV lacks); or infecting susceptible cells with a rAAV containing exogenous DNA including DNA for expression, wherein the recombinant lacks functioning cap and/or rep, and transfecting said cells with a plasmid supplying cap and/or rep function that the rAAV lacks; or infecting susceptible cells with a rAAV containing exogenous DNA including DNA for expression, wherein the recombinant lacks functioning cap and/or rep, wherein said cells supply cap and/or rep function that the recombinant lacks; or transfecting the susceptible cells with an AAV lacking functioning cap and/or rep and plasmids for inserting exogenous DNA into the recombinant so that the exogenous DNA is expressed by the recombinant and for supplying rep and/or cap functions whereby transfection results in an rAAV containing the exogenous DNA including DNA for expression that lacks functioning cap and/or rep.

The rAAV can be from an AAV as herein described, and advantageously can be an rAAV1, rAAV2, AAV5 or rAAV having hybrid or capsid which may comprise AAV1, AAV2, AAV5 or any combination thereof. One can select the AAV of the rAAV with regard to the cells to be targeted by the rAAV; e.g., one can select AAV serotypes 1, 2, 5 or a hybrid or capsid AAV1, AAV2, AAV5 or any combination thereof for targeting brain or neuronal cells; and one can select AAV4 for targeting cardiac tissue. In addition to 293 cells, other cells that can be used in the practice of the invention and the relative infectivity of certain AAV serotypes in vitro as to these cells (see Grimm, D. et al, J. Virol. 82: 5887-5911 (2008)) are as follows:

TABLE 5

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

The invention provides rAAV that contains or consists essentially of an exogenous nucleic acid molecule encoding a CRISPR (Clustered Regularly Interspaced Short Palindromic Repeats) system, e.g., a plurality of cassettes comprising or consisting a first cassette comprising or consisting essentially of a promoter, a nucleic acid molecule encoding a CRISPR-associated (Cas) protein (putative nuclease or helicase proteins), e.g., Cas9 and a terminator, and a two, or more, advantageously up to the packaging size limit of the vector, e.g., in total (including the first cassette) five, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator (where N is a number that can be inserted that is at an upper limit of the packaging size limit of the vector), or two or more individual rAAVs, each containing one or more than one cassette of a CRISPR system, e.g., a first rAAV containing the first cassette comprising or consisting essentially of a promoter, a nucleic acid molecule encoding Cas, e.g., Cas9 and a terminator, and a second rAAV containing a plurality, four, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator (where N is a number that can be inserted that is at an upper limit of the packaging size limit of the vector). As rAAV is a DNA virus, the nucleic acid molecules in the herein discussion concerning AAV or rAAV are advantageously DNA. The promoter is in some embodiments advantageously human Synapsin I promoter (hSyn).

Additional methods for the delivery of nucleic acids to cells are known to those skilled in the art. See, for example, US20030087817, incorporated herein by reference. In some embodiments, a host cell is transiently or non-transiently transfected with one or more vectors described herein. In some embodiments, a cell is transfected as it naturally occurs in a subject. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO—IR, CHO-K1, CHO-K2, CHO-T, CHO Dhfr -/-, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN-5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)). In some embodiments, a cell transfected with one or more vectors described herein is used to establish a new cell line comprising one or more vector-derived sequences. In some embodiments, a cell transiently transfected with the components of a CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In another embodiment, a fluid delivery device with an array of needles (see, e.g., US Patent Publication No. 20110230839 assigned to the Fred Hutchinson Cancer Research Center) may be contemplated for delivery of CRISPR Cas to solid tissue. A device of US Patent Publication No. 20110230839 for delivery of a fluid to a solid tissue may comprise a plurality of needles arranged in an array; a plurality of reservoirs, each in fluid communication with a respective one of the plurality of needles; and a plurality of actuators operatively coupled to respective ones of the plurality of reservoirs and configured to control a fluid pressure within the reservoir. In certain embodiments each of the plurality of actuators may comprise one of a plurality of plungers, a first end of each of the plurality of plungers being received in a respective one of the plurality of reservoirs, and in certain further embodiments the plungers of the plurality of plungers are operatively coupled together at respective second ends so as to be simultaneously depressable. Certain still further embodiments may comprise a plunger driver configured to depress all of the plurality of plungers at a selectively variable rate. In other embodiments each of the plurality of actuators may comprise one of a plurality of fluid transmission lines having first and second ends, a first end of each of the plurality of fluid transmission lines being coupled to a respective one of the plurality of reservoirs. In other embodiments the device may comprise a fluid pressure source, and each of the plurality of actuators comprises a fluid coupling between the fluid pressure source and a respective one of the plurality of reservoirs. In further embodiments the fluid pressure source may comprise at least one of a compressor, a vacuum accumulator, a peristaltic pump, a master cylinder, a microfluidic pump, and a valve. In another embodiment, each of the plurality of needles may comprise a plurality of ports distributed along its length.

Modifying a Target

In one aspect, the invention provides for methods of modifying a target polynucleotide in a eukaryotic cell, which may be in vivo, ex vivo or in vitro. In some embodiments, the method comprises sampling a cell or population of cells from a human or non-human animal, or a plant, and modifying the cell or cells. Culturing may occur at any stage ex vivo. The cell or cells may even be re-introduced into the non-human animal or plant. For re-introduced cells it is particularly preferred that the cells are stem cells. In some embodiments, the method comprises allowing a CRISPR complex to bind to the target polynucleotide to effect cleavage of said target polynucleotide thereby modifying the target polynucleotide, wherein the CRISPR complex comprises a CRISPR enzyme complexed with a guide sequence hybridized or hybridizable to a target sequence within said target polynucleotide, wherein said guide sequence is linked to a tracr mate sequence which in turn hybridizes to a tracr sequence.

In one aspect, the invention provides a method of modifying expression of a polynucleotide in a eukaryotic cell. In some embodiments, the method comprises allowing a CRISPR complex to bind to the polynucleotide such that said binding results in increased or decreased expression of said polynucleotide; wherein the CRISPR complex comprises a CRISPR enzyme complexed with a guide sequence hybridized or hybridizable to a target sequence within said polynucleotide, wherein said guide sequence is linked to a tracr mate sequence which in turn hybridizes to a tracr sequence. Similar considerations and conditions apply as above for methods of modifying a target polynucleotide. In fact, these sampling, culturing and re-introduction options apply across the aspects of the present invention. Indeed, in any aspect of the invention, the CRISPR complex may comprise a CRISPR enzyme complexed with a guide sequence hybridized or hybridizable to a target sequence, wherein said guide sequence may be linked to a tracr mate sequence which in turn may hybridize to a tracr sequence. Similar considerations and conditions apply as above for methods of modifying a target polynucleotide.

Kits

In one aspect, the invention provides kits containing any one or more of the elements disclosed in the above methods and compositions. Elements may be provided individually or in combinations, and may be provided in any suitable container, such as a vial, a bottle, or a tube. In some embodiments, the kit includes instructions in one or more languages, for example in more than one language. In some embodiments, a kit comprises one or more reagents for use in a process utilizing one or more of the elements described herein. Reagents may be provided in any suitable container. For example, a kit may provide one or more reaction or storage buffers. Reagents may be provided in a form that is usable in a particular assay, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more oligonucleotides corresponding to a guide sequence for insertion into a vector so as to operably link the guide sequence and a regulatory element. In some embodiments, the kit comprises a homologous recombination template polynucleotide. In some embodiments, the kit comprises one or more of the vectors and/or one or more of the polynucleotides described herein. The kit may advantageously allows to provide all elements of the systems of the invention.

CRISPR Complex

Figure 29:
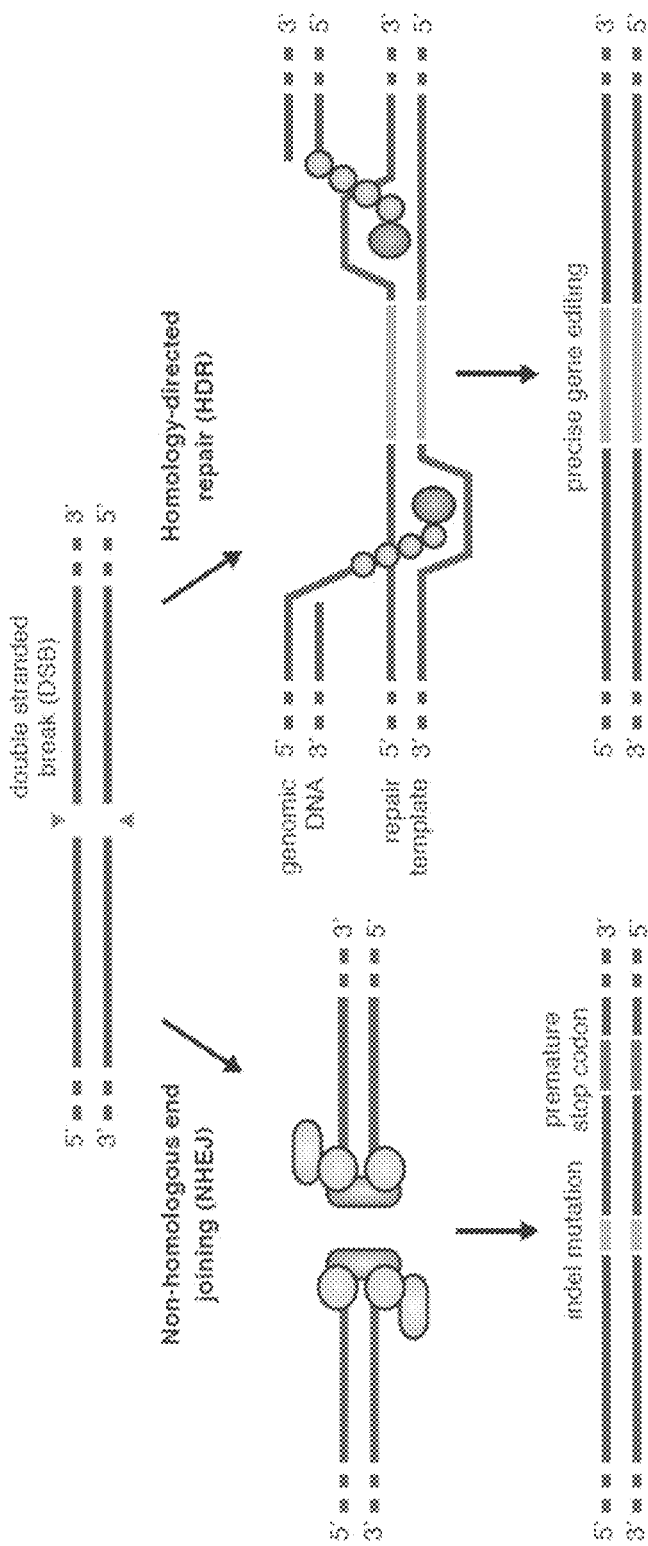
FIG. 29 shows how DNA double-strand break (DSB) repair promotes gene editing. In the error-prone non-homologous end joining (NHEJ) pathway, the ends of a DSB are processed by endogenous DNA repair machineries and rejoined together, which can result in random insertion/deletion (indel) mutations at the site of junction. Indel mutations occurring within the coding region of a gene can result in frame-shift and a premature stop codon, leading to gene knockout. Alternatively, a repair template in the form of a plasmid or single-stranded oligodeoxynucleotides (ssODN) can be supplied to leverage the homology-directed repair (HDR) pathway, which allows high fidelity and precise editing.

In one aspect, the invention provides methods for using one or more elements of a CRISPR system. The CRISPR complex of the invention provides an effective means for modifying a target polynucleotide. The CRISPR complex of the invention has a wide variety of utility including modifying (e.g., deleting, inserting, translocating, inactivating) a target polynucleotide in a multiplicity of cell types. An exemplary CRISPR complex comprises a CRISPR enzyme complexed with a guide sequence hybridized or hybridizable to a target sequence within the target polynucleotide. The guide sequence is linked to a tracr mate sequence, which in turn hybridizes to a tracr sequence. In one embodiment, this invention provides a method of cleaving a target polynucleotide. The method comprises modifying a target polynucleotide using a CRISPR complex that binds to the target polynucleotide and effect cleavage of said target polynucleotide. Typically, the CRISPR complex of the invention, when introduced into a cell, creates a break (e.g., a single or a double strand break) in the genome sequence. For example, the method can be used to cleave an integrated viral gene in a cell. The break created by the CRISPR complex can be repaired by a repair processes such as the error prone non-homologous end joining (NHEJ) pathway or the high fidelity homology-directed repair (HDR) (FIG. 29). During these repair process, an exogenous polynucleotide template can be introduced into the genome sequence. In some methods, the HDR process is used modify genome sequence. For example, an exogenous polynucleotide template comprising a sequence to be integrated flanked by an upstream sequence and a downstream sequence is introduced into a cell. The upstream and downstream sequences share sequence similarity with either side of the site of integration in the chromosome. Where desired, a donor polynucleotide can be DNA, e.g., a DNA plasmid, a bacterial artificial chromosome (BAC), a yeast artificial chromosome (YAC), a viral vector, a linear piece of DNA, a PCR fragment, a naked nucleic acid, or a nucleic acid complexed with a delivery vehicle such as a liposome or poloxamer. The exogenous polynucleotide template comprises a sequence to be integrated (e.g., a mutated gene). The sequence for integration may be a sequence endogenous or exogenous to the cell. Examples of a sequence to be integrated include polynucleotides encoding a protein or a non-coding RNA (e.g., a microRNA). Thus, the sequence for integration may be operably linked to an appropriate control sequence or sequences. Alternatively, the sequence to be integrated may provide a regulatory function. The upstream and downstream sequences in the exogenous polynucleotide template are selected to promote recombination between the chromosomal sequence of interest and the donor polynucleotide. The upstream sequence is a nucleic acid sequence that shares sequence similarity with the genome sequence upstream of the targeted site for integration. Similarly, the downstream sequence is a nucleic acid sequence that shares sequence similarity with the chromosomal sequence downstream of the targeted site of integration. The upstream and downstream sequences in the exogenous polynucleotide template can have 75%, 80%, 85%, 90%, 95%, or 100% sequence identity with the targeted genome sequence. Preferably, the upstream and downstream sequences in the exogenous polynucleotide template have about 95%, 96%, 97%, 98%, 99%, or 100% sequence identity with the targeted genome sequence. In some methods, the upstream and downstream sequences in the exogenous polynucleotide template have about 99% or 100% sequence identity with the targeted genome sequence. An upstream or downstream sequence may comprise from about 20 bp to about 2500 bp, for example, about 50, 100, 200, 300, 400, 500, 600, 700, 800, 900, 1000, 1100, 1200, 1300, 1400, 1500, 1600, 1700, 1800, 1900, 2000, 2100, 2200, 2300, 2400, or 2500 bp. In some methods, the exemplary upstream or downstream sequence have about 200 bp to about 2000 bp, about 600 bp to about 1000 bp, or more particularly about 700 bp to about 1000 bp. In some methods, the exogenous polynucleotide template may further comprise a marker. Such a marker may make it easy to screen for targeted integrations. Examples of suitable markers include restriction sites, fluorescent proteins, or selectable markers. The exogenous polynucleotide template of the invention can be constructed using recombinant techniques (see, for example, Sambrook et al., 2001 and Ausubel et al., 1996). In an exemplary method for modifying a target polynucleotide by integrating an exogenous polynucleotide template, a double stranded break is introduced into the genome sequence by the CRISPR complex, the break is repaired via homologous recombination an exogenous polynucleotide template such that the template is integrated into the genome. The presence of a double-stranded break facilitates integration of the template.

In other embodiments, this invention provides a method of modifying expression of a polynucleotide in a eukaryotic cell. The method comprises decreasing expression of a target polynucleotide by using a CRISPR complex that binds to the polynucleotide. In some methods, a target polynucleotide can be inactivated to effect the modification of the expression in a cell. For example, upon the binding of a CRISPR complex to a target sequence in a cell, the target polynucleotide is inactivated such that the sequence is not transcribed, the coded protein or RNA is not produced, or the sequence does not function as the wild-type sequence does. For example, a protein or microRNA coding sequence may be inactivated such that the protein or microRNA is not produced. In some methods, a control sequence can be inactivated such that it no longer functions as a control sequence. As used herein, "control sequence" refers to any nucleic acid sequence that effects the transcription, translation, or accessibility of a nucleic acid sequence. Examples of a control sequence include, a promoter, a transcription terminator, and an enhancer are control sequences. The inactivated target sequence may include a deletion mutation (i.e., deletion of one or more nucleotides), an insertion mutation (i.e., insertion of one or more nucleotides), or a nonsense mutation (i.e., substitution of a single nucleotide for another nucleotide such that a stop codon is introduced). In some methods, the inactivation of a target sequence results in "knock-out" of the target sequence.

The term "wild type StCas9" refers to wild type Cas9 from *S. thermophilus*, the protein sequence of which is given in the SwissProt database under accession number G3ECR1. Similarly, *S. pyogenes* Cas9 is included in SwissProt under accession number Q99ZW2.

Preclinical Translation

To switch to a CRISPR/Cas system compatible with clinically-tested liver-directed gene delivery, Applicants may switch from using SpCas9 to the smaller SaCas9.

A first step is to redesign and produce sgRNA sequences compatible with the SaCas9 PAM. Then, the sgRNAs are cloned into a viral vector (likely lentiviral for initial in vitro cell line studies) and these new guides are screened for their ability to cleave cccDNA in de novo infections. These experiments use the HepG2-hNTCP knockin cell lines and HBV virions purified from HepG2.2.15 cells. The screen is performed either with guides in individual wells side-by-side, or using a pooled format in which lentivirus is produced with a pool of all possible sgRNA sequences against HBV, and then deep sequencing identifies regions of the HBV genome most susceptible to cleavage by SaCas9.

Once a smaller list of 3-10 guides is chosen, more targeted experiments are performed in both in vitro and in vivo models of HBV infection in primary human hepatocytes (see e.g., Schlomai et al., (2014) Proceedings of the National Academy of Sciences, 111(33): 12193-12198; Bissig et al., (2014) Journal of Clinical Investigation, 120(3): 924-930; Legrand N et al. (2009) Cell Host & Microbe, 6(1): 5-9). These experiments can also utilize targeting with multiple sgRNAs simultaneously to induce cccDNA fragmentation). Additional possibilities include using other delivery systems (perhaps nonviral) as herein described.

Rationale for choosing appropriate sgRNAs for anti-HBV CRISPR/Cas9 systems: The process is a multistep one in which several parameters should be optimized: efficacy of the sgRNA sequence, targeting to an accessible part of cccDNA, conservation of the target sequence across viral genotypes, and minimization of target sequence homology to the human genome. These criteria should be general criteria across all episomal viruses, although the specifics may differ (for example, HBV cccDNA seems to be most accessible to cleavage in the ORF for Core, and it is possible that latent HSV may be most accessible in the region encoding latency-associated transcript LAT). The general workflow is as follows:

- Use CRISPR design tool to identify all possible sgRNAs for the virus of interest (for targeting dsDNA forms, such as HBV, look at targets on both positive and negative strands), based on the PAM for the Cas9 of interest (e.g. SpCas0, SaCas9)
- Use available efficacy prediction tools (e.g. Doench et al. 2014. Nat Biotech for SpCas9) to predict on-target efficacy of the sgRNAs for initial prioritization
- Perform some combination of literature search and pilot experiments using sgRNAs targeting diverse regions of the viral genome, followed by assessing cleavage efficiency at these sites, to determine which parts of viral genome are most efficiently cleaved by Cas9. Prioritize sgRNAs that hit these regions.
- From this downselected list of sgRNAs, further prioritize by how strongly conserved the target sequences are across viral genotypes. This can be done by performing primer BLAST against the full set of viral whole genome sequences deposited in GenBank. For example, for HBV there are a little over 5000 whole genome sequences from different strains and patient isolates. Ideal conservation across these sequences is 90+%.
- Finally, further downselect by choosing sgRNAs that have low homology to the human genome—typically this will not be a problem for viral genomes, since they are generally divergent from human genomic sequences (perhaps endogenous retrovirus regions are an exception, but these are predominantly nonfunctional)
- Efficacy in vitro and in vivo, as well as selectivity and minimizatrion of off-target effects, can then be determined experimentally in the proper model systems.

Below exhaustive list of possible sgRNAs for both SaCas9 and SpCas9. In these tables, the columns correspond to the sgRNA target DNA sequence (target sequence+PAM), the strand on which the target sequence and PAM are found (cccDNA is double-stranded), the nucleotide of the circular HBV genome at which the target sequence starts (HBV cccDNA is 3182 bp total), whether the sgRNA targets the Core ORF (which Applicants have found to be most capable of cleavage by Cas9), and finally whether or not the sgRNA is very close (+/−50 nt) on the HBV genome to where Applicants' most effective sgRNA (g17) targets.

TABLE 6

SaCas9 sgRNAs

| 20 nt guide + 5 nt PAM | SEQ ID NO: | nt Start | Sense | Core? | Close to G17? |
|---|---|---|---|---|---|
| CACCAAACTCTGCAAGATCCCAGAG | 94 | 16 | Positive | | |
| AAACTCTGCAAGATCCCAGAGTGAG | 95 | 20 | Positive | | |
| ACTCTGCAAGATCCCAGAGTGAGAG | 96 | 22 | Positive | | |
| CCCTGCTGGTGGCTCCAGTTCAGGA | 97 | 57 | Positive | | |
| CCTGCTGGTGGCTCCAGTTCAGGAG | 98 | 58 | Positive | | |
| CTCCCTTATCGTCAATCTTCTCGAG | 99 | 110 | Positive | | |
| CCCTTATCGTCAATCTTCTCGAGGA | 100 | 112 | Positive | | |
| ATCGTCAATCTTCTCGAGGATTGGG | 101 | 117 | Positive | | |
| TCGTCAATCTTCTCGAGGATTGGGG | 102 | 118 | Positive | | |
| CGTCAATCTTCTCGAGGATTGGGGA | 103 | 119 | Positive | | |
| CGAGGATTGGGGACCCTGCGCTGAA | 104 | 131 | Positive | | |
| TTGGGGACCCTGCGCTGAACATGGA | 105 | 137 | Positive | | |
| TGGGGACCCTGCGCTGAACATGGAG | 106 | 138 | Positive | | |
| GGGACCCTGCGCTGAACATGGAGAA | 107 | 140 | Positive | | |
| GAACATGGAGAACATCACATCAGGA | 108 | 153 | Positive | | |
| GAACATCACATCAGGATTCCTAGGA | 109 | 162 | Positive | | |
| GACCCCTTCTCGTGTTACAGGCGGG | 110 | 185 | Positive | | |
| ACCCCTTCTCGTGTTACAGGCGGGG | 111 | 186 | Positive | | |
| GCGGGGTTTTCTTGTTGACAAGAA | 112 | 205 | Positive | | |
| CAAGAATCCTCACAATACCGCAGAG | 113 | 224 | Positive | | |
| CCGCAGAGTCTAGACTCGTGGTGGA | 114 | 241 | Positive | | |
| GTGGACTTCTCTCAATTTTCTAGGG | 115 | 261 | Positive | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| TGGACTTCTCTCAATTTTCTAGGGG | 116 | 262 | Positive | | |
| GGACTTCTCTCAATTTTCTAGGGGG | 117 | 263 | Positive | | |
| GACTTCTCTCAATTTTCTAGGGGGA | 118 | 264 | Positive | | |
| ACTTCTCTCAATTTTCTAGGGGGAA | 119 | 265 | Positive | | |
| CCAACTTGTCCTGGTTATCGCTGGA | 120 | 355 | Positive | | |
| TCATCTTCTTGTTGGTTCTTCTGGA | 121 | 428 | Positive | | |
| GCCCGTTTGTCCTCTAATTCCAGGA | 122 | 468 | Positive | | |
| CAGGATCCTCAACCACCAGCACGGG | 123 | 488 | Positive | | |
| AGGATCCTCAACCACCAGCACGGGA | 124 | 489 | Positive | | |
| ACCACCAGCACGGGACCATGCCGAA | 125 | 499 | Positive | | |
| AACCTGCATGACTACTGCTCAAGGA | 126 | 522 | Positive | | |
| ACCTGCATGACTACTGCTCAAGGAA | 127 | 523 | Positive | | |
| CCTGTTGCTGTACCAAACCTTCGGA | 128 | 563 | Positive | | |
| TTGCTGTACCAAACCTTCGGACGGA | 129 | 567 | Positive | | |
| TGCTGTACCAAACCTTCGGACGGAA | 130 | 568 | Positive | | |
| TGTATTCCCATCCCATCATCCTGGG | 131 | 601 | Positive | | |
| CATCCCATCATCCTGGGCTTTCGGA | 132 | 609 | Positive | | |
| ATCCCATCATCCTGGGCTTTCGGAA | 133 | 610 | Positive | | |
| TGGGCTTTCGGAAAATTCCTATGGG | 134 | 622 | Positive | | |
| GGGCTTTCGGAAAATTCCTATGGGA | 135 | 623 | Positive | | |
| GGCTTTCGGAAAATTCCTATGGGAG | 136 | 624 | Positive | | |
| TTCGGAAAATTCCTATGGGAGTGGG | 137 | 628 | Positive | | |
| GCCATTTGTTCAGTGGTTCGTAGGG | 138 | 687 | Positive | | |
| ACTGTTTGGCTTTCAGTTATATGGA | 139 | 721 | Positive | | |
| GTTATATGGATGATGTGGTATTGGG | 140 | 736 | Positive | | |
| TTATATGGATGATGTGGTATTGGGG | 141 | 737 | Positive | | |
| TATATGGATGATGTGGTATTGGGGG | 142 | 738 | Positive | | |
| GGCCAAGTCTGTACAGCATCTTGAG | 143 | 761 | Positive | | |
| TTACCAATTTTCTTTTGTCTTTGGG | 144 | 802 | Positive | | |
| ATTTAAACCCTAACAAAACAAAGAG | 145 | 832 | Positive | | |
| AACCCTAACAAAACAAAGAGATGGG | 146 | 837 | Positive | | |
| ACCCTAACAAAACAAAGAGATGGGG | 147 | 838 | Positive | | |
| CAAAGAGATGGGGTTACTCTCTGAA | 148 | 850 | Positive | | |
| GGGGTTACTCTCTGAATTTTATGGG | 149 | 859 | Positive | | |
| GAATTTTATGGGTTATGTCATTGGA | 150 | 872 | Positive | | |
| AATTTTATGGGTTATGTCATTGGAA | 151 | 873 | Positive | | |
| GGGTTATGTCATTGGAAGTTATGGG | 152 | 881 | Positive | | |
| AAGTTATGGGTCCTTGCCACAAGAA | 153 | 896 | Positive | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| ACACATCATACAAAAAATCAAAGAA | 154 | 920 | Positive | | |
| CAAAAAATCAAAGAATGTTTTAGAA | 155 | 930 | Positive | | |
| CCTATTAACAGGCCTATTGATTGGA | 156 | 960 | Positive | | |
| CTATTAACAGGCCTATTGATTGGAA | 157 | 961 | Positive | | |
| ATTGATTGGAAAGTATGTCAACGAA | 158 | 975 | Positive | | |
| GGAAAGTATGTCAACGAATTGTGGG | 159 | 982 | Positive | | |
| GTCAACGAATTGTGGGTCTTTTGGG | 160 | 991 | Positive | | |
| CCTTTCTGTGTAAACAATACCTGAA | 161 | 1117 | Positive | | |
| GCTGACGCAACCCCCACTGGCTGGG | 162 | 1188 | Positive | | |
| CTGACGCAACCCCCACTGGCTGGGG | 163 | 1189 | Positive | | |
| CCACTGGCTGGGGCTTGGTCATGGG | 164 | 1201 | Positive | | |
| CATGGGCCATCAGCGCGTGCGTGGA | 165 | 1220 | Positive | | |
| ATGGGCCATCAGCGCGTGCGTGGAA | 166 | 1221 | Positive | | |
| CTCCTCTGCCGATCCATACTGCGGA | 167 | 1255 | Positive | | |
| TCCTCTGCCGATCCATACTGCGGAA | 168 | 1256 | Positive | | |
| TTGTTTTGCTCGCAGCAGGTCTGGA | 169 | 1292 | Positive | | |
| TGTTTTGCTCGCAGCAGGTCTGGAG | 170 | 1293 | Positive | | |
| CAGGTCTGGAGCAAACATTATCGGG | 171 | 1307 | Positive | | |
| AGGTCTGGAGCAAACATTATCGGGA | 172 | 1308 | Positive | | |
| CTGCTAGGCTGTGCTGCCAACTGGA | 173 | 1380 | Positive | | |
| TGCTGCCAACTGGATCCTGCGCGGG | 174 | 1391 | Positive | | |
| GCTGCCAACTGGATCCTGCGCGGGA | 175 | 1392 | Positive | | |
| TTGTTTACGTCCCGTCGGCGCTGAA | 176 | 1423 | Positive | | |
| TCCCGTCGGCGCTGAATCCTGCGGA | 177 | 1432 | Positive | | |
| AATCCTGCGGACGACCCTTCTCGGG | 178 | 1446 | Positive | | |
| ATCCTGCGGACGACCCTTCTCGGGG | 179 | 1447 | Positive | | |
| ACGACCCTTCTCGGGGTCGCTTGGG | 180 | 1456 | Positive | | |
| CGACCCTTCTCGGGGTCGCTTGGGA | 181 | 1457 | Positive | | |
| GTCTGCCGTTCCGACCGACCACGGG | 182 | 1501 | Positive | | |
| TCTGCCGTTCCGACCGACCACGGGG | 183 | 1502 | Positive | | |
| CGGGGCGCACCTCTCTTTACGCGGA | 184 | 1522 | Positive | | |
| CGTCTGTGCCTTCTCATCTGCCGGA | 185 | 1552 | Positive | | |
| GCTTCACCTCTGCACGTCGCATGGA | 186 | 1590 | Positive | | |
| CTTCACCTCTGCACGTCGCATGGAG | 187 | 1591 | Positive | | |
| CACGTCGCATGGAGACCACCGTGAA | 188 | 1602 | Positive | | |
| GAGACCACCGTGAACGCCCACCGAA | 189 | 1613 | Positive | | |
| TGTTGCCCAAGGTCTTACATAAGAG | 190 | 1638 | Positive | | |
| TTGCCCAAGGTCTTACATAAGAGGA | 191 | 1640 | Positive | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| GGTCTTACATAAGAGGACTCTTGGA | 192 | 1648 | Positive | | |
| TGCAATGTCAACGACCGACCTTGAG | 193 | 1678 | Positive | | |
| AAAGACTGTTTGTTTAAAGACTGGG | 194 | 1712 | Positive | | |
| AAGACTGTTTGTTTAAAGACTGGGA | 195 | 1713 | Positive | | |
| AGACTGTTTGTTTAAAGACTGGGAG | 196 | 1714 | Positive | | |
| ACTGTTTGTTTAAAGACTGGGAGGA | 197 | 1716 | Positive | | |
| CTGTTTGTTTAAAGACTGGGAGGAG | 198 | 1717 | Positive | | |
| TGTTTAAAGACTGGGAGGAGTTGGG | 199 | 1722 | Positive | | |
| GTTTAAAGACTGGGAGGAGTTGGGG | 200 | 1723 | Positive | | |
| TTTAAAGACTGGGAGGAGTTGGGGG | 201 | 1724 | Positive | | |
| TTAAAGACTGGGAGGAGTTGGGGGA | 202 | 1725 | Positive | | |
| TAAAGACTGGGAGGAGTTGGGGGAG | 203 | 1726 | Positive | | |
| AAGACTGGGAGGAGTTGGGGGAGGA | 204 | 1728 | Positive | | |
| AGACTGGGAGGAGTTGGGGGAGGAG | 205 | 1729 | Positive | | |
| TAGATTAAAGGTCTTTGTACTAGGA | 206 | 1756 | Positive | | |
| AGATTAAAGGTCTTTGTACTAGGAG | 207 | 1757 | Positive | | |
| TCAAGCCTCCAAGCTGTGCCTTGGG | 208 | 1866 | Positive | Yes | |
| AAGCTGTGCCTTGGGTGGCTTTGGG | 209 | 1876 | Positive | Yes | Yes |
| AGCTGTGCCTTGGGTGGCTTTGGGG | 210 | 1877 | Positive | Yes | Yes |
| GCCTTGGGTGGCTTTGGGGCATGGA | 211 | 1883 | Positive | Yes | Yes |
| CATGGACATCGACCCTTATAAAGAA | 212 | 1902 | Positive | Yes | Yes |
| CATCGACCCTTATAAAGAATTTGGA | 213 | 1908 | Positive | Yes | Yes |
| ATCGACCCTTATAAAGAATTTGGAG | 214 | 1909 | Positive | Yes | Yes |
| ATAAAGAATTTGGAGCTACTGTGGA | 215 | 1919 | Positive | Yes | Yes |
| TAAAGAATTTGGAGCTACTGTGGAG | 216 | 1920 | Positive | Yes | Yes |
| TCTGACTTCTTTCCTTCAGTACGAG | 217 | 1963 | Positive | Yes | Yes |
| GATACCGCCTCAGCTCTGTATCGGG | 218 | 1996 | Positive | Yes | |
| ATACCGCCTCAGCTCTGTATCGGGA | 219 | 1997 | Positive | Yes | |
| TACCGCCTCAGCTCTGTATCGGGAA | 220 | 1998 | Positive | Yes | |
| AGCTCTGTATCGGGAAGCCTTAGAG | 221 | 2007 | Positive | Yes | |
| TCGGGAAGCCTTAGAGTCTCCTGAG | 222 | 2016 | Positive | Yes | |
| CTCAGGCAAGCAATTCTTTGCTGGG | 223 | 2065 | Positive | Yes | |
| TCAGGCAAGCAATTCTTTGCTGGGG | 224 | 2066 | Positive | Yes | |
| CAGGCAAGCAATTCTTTGCTGGGGG | 225 | 2067 | Positive | Yes | |
| AGGCAAGCAATTCTTTGCTGGGGGG | 226 | 2068 | Positive | Yes | |
| GGCAAGCAATTCTTTGCTGGGGGGA | 227 | 2069 | Positive | Yes | |
| GCAAGCAATTCTTTGCTGGGGGGAA | 228 | 2070 | Positive | Yes | |
| GAACTAATGACTCTAGCTACCTGGG | 229 | 2092 | Positive | Yes | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| TAATGACTCTAGCTACCTGGGTGGG | 230 | 2096 | Positive | Yes | |
| CTACCTGGGTGGGTGTTAATTTGGA | 231 | 2108 | Positive | Yes | |
| TACCTGGGTGGGTGTTAATTTGGAA | 232 | 2109 | Positive | Yes | |
| AATTTGGAAGATCCAGCATCTAGAG | 233 | 2125 | Positive | Yes | |
| TCAGTTATGTCAACACTAATATGGG | 234 | 2159 | Positive | Yes | |
| TCACATTTCTTGTCTCACTTTTGGA | 235 | 2211 | Positive | Yes | |
| CACATTTCTTGTCTCACTTTTGGAA | 236 | 2212 | Positive | Yes | |
| ATTTCTTGTCTCACTTTTGGAAGAG | 237 | 2215 | Positive | Yes | |
| TTCTTGTCTCACTTTTGGAAGAGAA | 238 | 2217 | Positive | Yes | |
| TTTTGGAAGAGAAACCGTTATAGAG | 239 | 2229 | Positive | Yes | |
| TATAGAGTATTTGGTGTCTTTCGGA | 240 | 2247 | Positive | Yes | |
| ATAGAGTATTTGGTGTCTTTCGGAG | 241 | 2248 | Positive | Yes | |
| TATTTGGTGTCTTTCGGAGTGTGGA | 242 | 2254 | Positive | Yes | |
| CCCCTATCCTATCAACACTTCCGGA | 243 | 2312 | Positive | Yes | |
| CCCTATCCTATCAACACTTCCGGAA | 244 | 2313 | Positive | Yes | |
| GAAACTACTGTTGTTAGACGACGAG | 245 | 2335 | Positive | Yes | |
| AGACGACGAGGCAGGTCCCCTAGAA | 246 | 2350 | Positive | Yes | |
| CGACGAGGCAGGTCCCCTAGAAGAA | 247 | 2353 | Positive | Yes | |
| CGAGGCAGGTCCCCTAGAAGAAGAA | 248 | 2356 | Positive | Yes | |
| AGAACTCCCTCGCCTCGCAGACGAA | 249 | 2377 | Positive | Yes | |
| AGGTCTCAATCGCCGCGTCGCAGAA | 250 | 2401 | Positive | Yes | |
| CGTCGCAGAAGATCTCAATCTCGGG | 251 | 2416 | Positive | Yes | |
| GTCGCAGAAGATCTCAATCTCGGGA | 252 | 2417 | Positive | Yes | |
| TCGCAGAAGATCTCAATCTCGGGAA | 253 | 2418 | Positive | Yes | |
| AACCTCAATGTTAGTATTCCTTGGA | 254 | 2441 | Positive | | |
| GTATTCCTTGGACTCATAAGGTGGG | 255 | 2454 | Positive | | |
| TATTCCTTGGACTCATAAGGTGGGG | 256 | 2455 | Positive | | |
| ATTCCTTGGACTCATAAGGTGGGGA | 257 | 2456 | Positive | | |
| TTCCTTGGACTCATAAGGTGGGGAA | 258 | 2457 | Positive | | |
| GTACCTGTCTTTAATCCTCATTGGA | 259 | 2507 | Positive | | |
| TACCTGTCTTTAATCCTCATTGGAA | 260 | 2508 | Positive | | |
| CCAAGACATTATCAAAAATGTGAA | 261 | 2563 | Positive | | |
| TGTAGGCCCACTTACAGTTAATGAG | 262 | 2593 | Positive | | |
| TAGGCCCACTTACAGTTAATGAGAA | 263 | 2595 | Positive | | |
| CCACTTACAGTTAATGAGAAAAGAA | 264 | 2600 | Positive | | |
| AGGTTACCAAATATTTACCATTGGA | 265 | 2661 | Positive | | |
| CCAAATATTTACCATTGGATAAGGG | 266 | 2667 | Positive | | |
| GGGTATTAAACCTTATTATCCAGAA | 267 | 2689 | Positive | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| AGACACTATTTACACACTCTATGGA | 268 | 2741 | Positive | | |
| GACACTATTTACACACTCTATGGAA | 269 | 2742 | Positive | | |
| ATTTACACACTCTATGGAAGGCGGG | 270 | 2748 | Positive | | |
| GGAAGGCGGGTATATTATATAAGAG | 271 | 2763 | Positive | | |
| AAGGCGGGTATATTATATAAGAGAG | 272 | 2765 | Positive | | |
| GGCGGGTATATTATATAAGAGAGAA | 273 | 2767 | Positive | | |
| AACACATAGCGCCTCATTTTGTGGG | 274 | 2794 | Positive | | |
| TTTTGTGGGTCACCATATTCTTGGG | 275 | 2810 | Positive | | |
| TTTGTGGGTCACCATATTCTTGGGA | 276 | 2811 | Positive | | |
| TTGTGGGTCACCATATTCTTGGGAA | 277 | 2812 | Positive | | |
| TTGGGAACAAGATCTACAGCATGGG | 278 | 2830 | Positive | | |
| TGGGAACAAGATCTACAGCATGGGG | 279 | 2831 | Positive | | |
| ACAAGATCTACAGCATGGGGCAGAA | 280 | 2836 | Positive | | |
| ATCTTTCCACCAGCAATCCTCTGGG | 281 | 2860 | Positive | | |
| TCTTTCCACCAGCAATCCTCTGGGA | 282 | 2861 | Positive | | |
| GATTCTTTCCCGACCACCAGTTGGA | 283 | 2884 | Positive | | |
| CACCAGTTGGATCCAGCCTTCAGAG | 284 | 2898 | Positive | | |
| GCAAACACAGCAAATCCAGATTGGG | 285 | 2922 | Positive | | |
| CAAACACAGCAAATCCAGATTGGGA | 286 | 2923 | Positive | | |
| ATTGGGACTTCAATCCCAACAAGGA | 287 | 2941 | Positive | | |
| CTGGCCAGACGCCAACAAGGTAGGA | 288 | 2969 | Positive | | |
| TGGCCAGACGCCAACAAGGTAGGAG | 289 | 2970 | Positive | | |
| AGACGCCAACAAGGTAGGAGCTGGA | 290 | 2975 | Positive | | |
| GACGCCAACAAGGTAGGAGCTGGAG | 291 | 2976 | Positive | | |
| CAAGGTAGGAGCTGGAGCATTCGGG | 292 | 2984 | Positive | | |
| TAGGAGCTGGAGCATTCGGGCTGGG | 293 | 2989 | Positive | | |
| GCTGGGTTTCACCCCACCGCACGGA | 294 | 3008 | Positive | | |
| CTGGGTTTCACCCCACCGCACGGAG | 295 | 3009 | Positive | | |
| CCCCACCGCACGGAGGCCTTTTGGG | 296 | 3019 | Positive | | |
| CCCACCGCACGGAGGCCTTTTGGGG | 297 | 3020 | Positive | | |
| CCGCACGGAGGCCTTTTGGGGTGGA | 298 | 3024 | Positive | | |
| CGCACGGAGGCCTTTTGGGGTGGAG | 299 | 3025 | Positive | | |
| TGGGGTGGAGCCCTCAGGCTCAGGG | 300 | 3040 | Positive | | |
| TGCCTCCACCAATCGCCAGACAGGA | 301 | 3098 | Positive | | |
| GCCTCCACCAATCGCCAGACAGGAA | 302 | 3099 | Positive | | |
| CTACCCCGCTGTCTCCACCTTTGAG | 303 | 3130 | Positive | | |
| ACCCCGCTGTCTCCACCTTTGAGAA | 304 | 3132 | Positive | | |
| GAAAGGTTGTGGAATTT | 305 | 3167 | Negative | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| GTGAAAGGTTGTGGAATTC | 306 | 3165 | Negative | | |
| TTTGGTGAAAGGTTGTGGAATTA | 307 | 3161 | Negative | | |
| AGGATGAGTGTTTCTCAAAGGTGGA | 308 | 16 | Negative | | |
| GGATGAGTGTTTCTCAAAGGTGGAG | 309 | 17 | Negative | | |
| GTTTCTCAAAGGTGGAGACAGCGGG | 310 | 25 | Negative | | |
| TTTCTCAAAGGTGGAGACAGCGGGG | 311 | 26 | Negative | | |
| GCCTTCCTGTCTGGCGATTGGTGGA | 312 | 57 | Negative | | |
| CCTTCCTGTCTGGCGATTGGTGGAG | 313 | 58 | Negative | | |
| TGTCTGGCGATTGGTGGAGGCAGGA | 314 | 64 | Negative | | |
| GTCTGGCGATTGGTGGAGGCAGGAG | 315 | 65 | Negative | | |
| GCGATTGGTGGAGGCAGGAGGCGGA | 316 | 70 | Negative | | |
| GGCAAAGTTTGTAGTATGCCCTGAG | 317 | 101 | Negative | | |
| GTTTGTAGTATGCCCTGAGCCTGAG | 318 | 107 | Negative | | |
| TTGTAGTATGCCCTGAGCCTGAGGG | 319 | 109 | Negative | | |
| CCCCAAAAGGCCTCCGTGCGGTGGG | 320 | 139 | Negative | | |
| CCCAAAAGGCCTCCGTGCGGTGGGG | 321 | 140 | Negative | | |
| AAAGGCCTCCGTGCGGTGGGGTGAA | 322 | 144 | Negative | | |
| GCGGTGGGGTGAAACCCAGCCCGAA | 323 | 156 | Negative | | |
| CGTCTGGCCAGGTGTCCTTGTTGGG | 324 | 204 | Negative | | |
| GTCTGGCCAGGTGTCCTTGTTGGGA | 325 | 205 | Negative | | |
| GCCAGGTGTCCTTGTTGGGATTGAA | 326 | 210 | Negative | | |
| GTTGGGATTGAAGTCCCAATCTGGA | 327 | 223 | Negative | | |
| CTGGATTTGCTGTGTTTGCTCTGAA | 328 | 243 | Negative | | |
| TGCTGTGTTTGCTCTGAAGGCTGGA | 329 | 250 | Negative | | |
| AGGCTGGATCCAACTGGTGGTCGGG | 330 | 267 | Negative | | |
| GGCTGGATCCAACTGGTGGTCGGGA | 331 | 268 | Negative | | |
| GCTGGATCCAACTGGTGGTCGGGAA | 332 | 269 | Negative | | |
| GATCCAACTGGTGGTCGGGAAAGAA | 333 | 273 | Negative | | |
| TGGTGGTCGGGAAAGAATCCCAGAG | 334 | 281 | Negative | | |
| GTGGTCGGGAAAGAATCCCAGAGGA | 335 | 283 | Negative | | |
| AGAATCCCAGAGGATTGCTGGTGGA | 336 | 294 | Negative | | |
| GAATCCCAGAGGATTGCTGGTGGAA | 337 | 295 | Negative | | |
| ATGCTGTAGATCTTGTTCCCAAGAA | 338 | 332 | Negative | | |
| AGAATATGGTGACCCACAAAATGAG | 339 | 353 | Negative | | |
| TATAATATACCCGCCTTCCATAGAG | 340 | 402 | Negative | | |
| GTGTGTAAATAGTGTCTAGTTTGGA | 341 | 426 | Negative | | |
| TGTGTAAATAGTGTCTAGTTTGGAA | 342 | 427 | Negative | | |
| GTAATGATTAACTAGATGTTCTGGA | 343 | 452 | Negative | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| TGGTAAATATTTGGTAACCTTTGGA | 344 | 503 | Negative | | |
| TCTTTTCTCATTAACTGTAAGTGGG | 345 | 560 | Negative | | |
| GTCTTGGTGTAAATGTATATTAGGA | 346 | 614 | Negative | | |
| TCTTGGTGTAAATGTATATTAGGAA | 347 | 615 | Negative | | |
| GGAAAGATGGTGTTTTCCAATGAG | 348 | 636 | Negative | | |
| AAAAGATGGTGTTTTCCAATGAGGA | 349 | 638 | Negative | | |
| AGGATTAAAGACAGGTACAGTAGAA | 350 | 659 | Negative | | |
| ATTAAAGACAGGTACAGTAGAAGAA | 351 | 662 | Negative | | |
| CCAGTAAAGTTCCCCACCTTATGAG | 352 | 693 | Negative | | |
| GTTCCCCACCTTATGAGTCCAAGGA | 353 | 701 | Negative | | |
| TTCCCCACCTTATGAGTCCAAGGAA | 354 | 702 | Negative | | |
| GAGTCCAAGGAATACTAACATTGAG | 355 | 715 | Negative | | |
| GAATACTAACATTGAGGTTCCCGAG | 356 | 724 | Negative | | |
| TAACATTGAGGTTCCCGAGATTGAG | 357 | 730 | Negative | | Yes |
| GATCTTCTGCGACGCGGCGATTGAG | 358 | 754 | Negative | | Yes |
| GGCGATTGAGACCTTCGTCTGCGAG | 359 | 769 | Negative | | Yes |
| TTGAGACCTTCGTCTGCGAGGCGAG | 360 | 774 | Negative | | Yes |
| GAGACCTTCGTCTGCGAGGCGAGGG | 361 | 776 | Negative | | Yes |
| AGACCTTCGTCTGCGAGGCGAGGGA | 362 | 777 | Negative | | Yes |
| GACCTTCGTCTGCGAGGCGAGGGAG | 363 | 778 | Negative | | Yes |
| AGGCGAGGGAGTTCTTCTTCTAGGG | 364 | 792 | Negative | | Yes |
| GGCGAGGGAGTTCTTCTTCTAGGGG | 365 | 793 | Negative | | Yes |
| GCGAGGGAGTTCTTCTTCTAGGGGA | 366 | 794 | Negative | | Yes |
| TCGTCTAACAACAGTAGTTTCCGGA | 367 | 828 | Negative | | Yes |
| CGTCTAACAACAGTAGTTTCCGGAA | 368 | 829 | Negative | | Yes |
| GTAGTTTCCGGAAGTGTTGATAGGA | 369 | 841 | Negative | | Yes |
| TTCCGGAAGTGTTGATAGGATAGGG | 370 | 846 | Negative | | Yes |
| TCCGGAAGTGTTGATAGGATAGGGG | 371 | 847 | Negative | | Yes |
| GGCATTTGGTGGTCTATAAGCTGGA | 372 | 870 | Negative | | Yes |
| GCATTTGGTGGTCTATAAGCTGGAG | 373 | 871 | Negative | | Yes |
| ATTTGGTGGTCTATAAGCTGGAGGA | 374 | 873 | Negative | | Yes |
| TTTGGTGGTCTATAAGCTGGAGGAG | 375 | 874 | Negative | | Yes |
| GGTCTATAAGCTGGAGGAGTGCGAA | 376 | 880 | Negative | | Yes |
| GAGGAGTGCGAATCCACACTCCGAA | 377 | 893 | Negative | | Yes |
| TAACGGTTTCTCTTCCAAAAGTGAG | 378 | 935 | Negative | | Yes |
| TTCTCTTCCAAAAGTGAGACAAGAA | 379 | 942 | Negative | | Yes |
| CCAAAAGTGAGACAAGAAATGTGAA | 380 | 949 | Negative | | Yes |
| GACAAGAAATGTGAAACCACAAGAG | 381 | 959 | Negative | | Yes |

TABLE 6-continued

SaCas9 sgRNAs

| 20 nt guide + 5 nt PAM | SEQ ID NO: | nt Start | Sense | Core? | Close to G17? |
|---|---|---|---|---|---|
| TGTGAAACCACAAGAGTTGCCTGAA | 382 | 968 | Negative | Yes | |
| GACTACTAGGTCTCTAGATGCTGGA | 383 | 1023 | Negative | Yes | |
| TTAACACCCACCCAGGTAGCTAGAG | 384 | 1057 | Negative | Yes | |
| GTCATTAGTTCCCCCCAGCAAAGAA | 385 | 1081 | Negative | Yes | |
| CCCAGCAAAGAATTGCTTGCCTGAG | 386 | 1094 | Negative | Yes | |
| GCTTGCCTGAGTGCAGTATGGTGAG | 387 | 1108 | Negative | Yes | |
| CCTGAGTGCAGTATGGTGAGGTGAA | 388 | 1113 | Negative | Yes | |
| ATGGTGAGGTGAACAATGCTCAGGA | 389 | 1125 | Negative | Yes | |
| TGGTGAGGTGAACAATGCTCAGGAG | 390 | 1126 | Negative | Yes | |
| GACTCTAAGGCTTCCCGATACAGAG | 391 | 1150 | Negative | Yes | |
| TAAGGCTTCCCGATACAGAGCTGAG | 392 | 1155 | Negative | Yes | |
| TACAGAGCTGAGGCGGTATCTAGAA | 393 | 1168 | Negative | Yes | |
| GGTATCTAGAAGATCTCGTACTGAA | 394 | 1182 | Negative | Yes | |
| ATCTAGAAGATCTCGTACTGAAGGA | 395 | 1185 | Negative | Yes | |
| TCTAGAAGATCTCGTACTGAAGGAA | 396 | 1186 | Negative | Yes | |
| GAAGATCTCGTACTGAAGGAAAGAA | 397 | 1190 | Negative | Yes | |
| TCGTACTGAAGGAAAGAAGTCAGAA | 398 | 1197 | Negative | Yes | |
| AAAGAAGTCAGAAGGCAAAAACGAG | 399 | 1209 | Negative | Yes | |
| AGAAGTCAGAAGGCAAAAACGAGAG | 400 | 1211 | Negative | Yes | Yes |
| AGTAGCTCCAAATTCTTTATAAGGG | 401 | 1245 | Negative | Yes | Yes |
| AAAGCCACCCAAGGCACAGCTTGGA | 402 | 1286 | Negative | Yes | Yes |
| AAGCCACCCAAGGCACAGCTTGGAG | 403 | 1287 | Negative | Yes | Yes |
| CCAAGGCACAGCTTGGAGGCTTGAA | 404 | 1294 | Negative | Yes | Yes |
| CAGCTTGGAGGCTTGAACAGTAGGA | 405 | 1302 | Negative | Yes | Yes |
| GGAGGCTTGAACAGTAGGACATGAA | 406 | 1308 | Negative | Yes | Yes |
| TTGAACAGTAGGACATGAACAAGAG | 407 | 1314 | Negative | Yes | |
| ATGAACAAGAGATGATTAGGCAGAG | 408 | 1328 | Negative | Yes | |
| CAAGAGATGATTAGGCAGAGGTGAA | 409 | 1333 | Negative | Yes | |
| AGTCTTTAAACAAACAGTCTTTGAA | 410 | 1450 | Negative | | |
| AAGGTCGGTCGTTGACATTGCAGAG | 411 | 1484 | Negative | | |
| GGTCGGTCGTTGACATTGCAGAGAG | 412 | 1486 | Negative | | |
| GTTGACATTGCAGAGAGTCCAAGAG | 413 | 1494 | Negative | | |
| GAGTCCTCTTATGTAAGACCTTGGG | 414 | 1516 | Negative | | |
| AAGACCTTGGGCAACATTCGGTGGG | 415 | 1530 | Negative | | |
| GGTGGTCTCCATGCGACGTGCAGAG | 416 | 1562 | Negative | | |
| TCTCCATGCGACGTGCAGAGGTGAA | 417 | 1567 | Negative | | |
| ATGCGACGTGCAGAGGTGAAGCGAA | 418 | 1572 | Negative | | |
| AAGTGCACACGGTCCGGCAGATGAG | 419 | 1595 | Negative | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| GTGCACACGGTCCGGCAGATGAGAA | 420 | 1597 | Negative | | |
| CGGCAGATGAGAAGGCACAGACGGG | 421 | 1609 | Negative | | |
| GGCAGATGAGAAGGCACAGACGGGG | 422 | 1610 | Negative | | |
| GCAGATGAGAAGGCACAGACGGGGA | 423 | 1611 | Negative | | |
| CAGATGAGAAGGCACAGACGGGGAG | 424 | 1612 | Negative | | |
| ACAGACGGGGAGTCCGCGTAAAGAG | 425 | 1625 | Negative | | |
| AGACGGGGAGTCCGCGTAAAGAGAG | 426 | 1627 | Negative | | |
| GAGGTGCGCCCCGTGGTCGGTCGGA | 427 | 1649 | Negative | | |
| AGGTGCGCCCCGTGGTCGGTCGGAA | 428 | 1650 | Negative | | |
| GTGGTCGGTCGGAACGGCAGACGGA | 429 | 1661 | Negative | | |
| TGGTCGGTCGGAACGGCAGACGGAG | 430 | 1662 | Negative | | |
| GTCGGTCGGAACGGCAGACGGAGAA | 431 | 1664 | Negative | | |
| GGTCGGAACGGCAGACGGAGAAGGG | 432 | 1667 | Negative | | |
| GTCGGAACGGCAGACGGAGAAGGGG | 433 | 1668 | Negative | | |
| TCGGAACGGCAGACGGAGAAGGGGA | 434 | 1669 | Negative | | |
| AACGGCAGACGGAGAAGGGGACGAG | 435 | 1673 | Negative | | |
| CGGCAGACGGAGAAGGGGACGAGAG | 436 | 1675 | Negative | | |
| GCAGACGGAGAAGGGGACGAGAGAG | 437 | 1677 | Negative | | |
| CGAGAGAGTCCCAAGCGACCCCGAG | 438 | 1694 | Negative | | |
| AGAGAGTCCCAAGCGACCCCGAGAA | 439 | 1696 | Negative | | |
| GAGTCCCAAGCGACCCCGAGAAGGG | 440 | 1699 | Negative | | |
| ACCCCGAGAAGGGTCGTCCGCAGGA | 441 | 1711 | Negative | | |
| GTCCGCAGGATTCAGCGCCGACGGG | 442 | 1726 | Negative | | |
| TCCGCAGGATTCAGCGCCGACGGGA | 443 | 1727 | Negative | | |
| GCGCCGACGGGACGTAAACAAAGGA | 444 | 1740 | Negative | | |
| TAAACAAAGGACGTCCCGCGCAGGA | 445 | 1754 | Negative | | |
| GGCAGCACAGCCTAGCAGCCATGGA | 446 | 1786 | Negative | | |
| CATGGATACGATGTATATTTGCGGG | 447 | 1805 | Negative | | |
| ATGGATACGATGTATATTTGCGGGA | 448 | 1806 | Negative | | |
| TGGATACGATGTATATTTGCGGGAG | 449 | 1807 | Negative | | |
| GATACGATGTATATTTGCGGGAGAG | 450 | 1809 | Negative | | |
| TACGATGTATATTTGCGGGAGAGGA | 451 | 1811 | Negative | | |
| ATATTTGCGGGAGAGGACAACAGAG | 452 | 1819 | Negative | | |
| ATGTTTGCTCCAGACCTGCTGCGAG | 453 | 1859 | Negative | | |
| CTGCGAGCAAAACAAGCGGCTAGGA | 454 | 1877 | Negative | | |
| TGCGAGCAAAACAAGCGGCTAGGAG | 455 | 1878 | Negative | | |
| GCGGCTAGGAGTTCCGCAGTATGGA | 456 | 1892 | Negative | | |
| AGTTCCGCAGTATGGATCGGCAGAG | 457 | 1901 | Negative | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| TTCCGCAGTATGGATCGGCAGAGGA | 458 | 1903 | Negative | | |
| TCCGCAGTATGGATCGGCAGAGGAG | 459 | 1904 | Negative | | |
| AGTATGGATCGGCAGAGGAGCCGAA | 460 | 1909 | Negative | | |
| CCATGACCAAGCCCCAGCCAGTGGG | 461 | 1959 | Negative | | |
| CATGACCAAGCCCCAGCCAGTGGGG | 462 | 1960 | Negative | | |
| ATGACCAAGCCCCAGCCAGTGGGGG | 463 | 1961 | Negative | | |
| TGGCACAGACCTGGCCGTTGCCGGG | 464 | 2003 | Negative | | |
| GACCTGGCCGTTGCCGGGCAACGGG | 465 | 2010 | Negative | | |
| ACCTGGCCGTTGCCGGGCAACGGGG | 466 | 2011 | Negative | | |
| AGGTTCAGGTATTGTTTACACAGAA | 467 | 2039 | Negative | | |
| CAGAAAGGCCTTGTAAGTTGGCGAG | 468 | 2059 | Negative | | |
| GAAAGGCCTTGTAAGTTGGCGAGAA | 469 | 2061 | Negative | | |
| CCTTGTAAGTTGGCGAGAAAGTGAA | 470 | 2067 | Negative | | |
| AAAGTGAAAGCCTGCTTAGATTGAA | 471 | 2084 | Negative | | |
| TAGATTGAATACATGCATACAAGGG | 472 | 2100 | Negative | | |
| TGCATACAAGGGCATTAACGCAGGA | 473 | 2113 | Negative | | |
| AGGATAACCACATTGTGTAAATGGG | 474 | 2134 | Negative | | |
| GGATAACCACATTGTGTAAATGGGG | 475 | 2135 | Negative | | |
| CCAATCAATAGGCCTGTTAATAGGA | 476 | 2200 | Negative | | |
| CAATCAATAGGCCTGTTAATAGGAA | 477 | 2201 | Negative | | |
| GTATGATGTGTTCTTGTGGCAAGGA | 478 | 2253 | Negative | | |
| ATGACATAACCCATAAAATTCAGAG | 479 | 2291 | Negative | | |
| GACATAACCCATAAAATTCAGAGAG | 480 | 2293 | Negative | | |
| ACCCCATCTCTTTGTTTTGTTAGGG | 481 | 2320 | Negative | | |
| AAATGTATACCCAAAGACAAAAGAA | 482 | 2348 | Negative | | |
| AAATTGGTAACAGCGGTAAAAAGGG | 483 | 2372 | Negative | | |
| AATTGGTAACAGCGGTAAAAAGGGA | 484 | 2373 | Negative | | |
| ATACCACATCATCCATATAACTGAA | 485 | 2427 | Negative | | |
| ATATAACTGAAAGCCAAACAGTGGG | 486 | 2441 | Negative | | |
| TATAACTGAAAGCCAAACAGTGGGG | 487 | 2442 | Negative | | |
| ATAACTGAAAGCCAAACAGTGGGGG | 488 | 2443 | Negative | | |
| TAACTGAAAGCCAAACAGTGGGGGA | 489 | 2444 | Negative | | |
| AACTGAAAGCCAAACAGTGGGGGAA | 490 | 2445 | Negative | | |
| AAACAGTGGGGAAAGCCCTACGAA | 491 | 2456 | Negative | | |
| GGGGAAAGCCCTACGAACCACTGAA | 492 | 2464 | Negative | | |
| GAACAAATGGCACTAGTAAACTGAG | 493 | 2486 | Negative | | |
| ATGGCACTAGTAAACTGAGCCAGGA | 494 | 2492 | Negative | | |
| TGGCACTAGTAAACTGAGCCAGGAG | 495 | 2493 | Negative | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| GCACTAGTAAACTGAGCCAGGAGAA | 496 | 2495 | Negative | | |
| AGTAAACTGAGCCAGGAGAAACGGG | 497 | 2500 | Negative | | |
| ACTGAGCCAGGAGAAACGGGCTGAG | 498 | 2505 | Negative | | |
| CGGGCTGAGGCCCACTCCCATAGGA | 499 | 2521 | Negative | | |
| GGGCTGAGGCCCACTCCCATAGGAA | 500 | 2522 | Negative | | |
| CCCACTCCCATAGGAATTTTCCGAA | 501 | 2531 | Negative | | |
| ATAGGAATTTTCCGAAAGCCCAGGA | 502 | 2540 | Negative | | |
| TTTTCCGAAAGCCCAGGATGATGGG | 503 | 2547 | Negative | | |
| TTTCCGAAAGCCCAGGATGATGGGA | 504 | 2548 | Negative | | |
| CGAAAGCCCAGGATGATGGGATGGG | 505 | 2552 | Negative | | |
| GAAAGCCCAGGATGATGGGATGGGA | 506 | 2553 | Negative | | |
| AAAGCCCAGGATGATGGGATGGGAA | 507 | 2554 | Negative | | |
| AATACAGGTGCAATTTCCGTCCGAA | 508 | 2577 | Negative | | |
| CCGAAGGTTTGGTACAGCAACAGGA | 509 | 2597 | Negative | | |
| CGAAGGTTTGGTACAGCAACAGGAG | 510 | 2598 | Negative | | |
| AAGGTTTGGTACAGCAACAGGAGGG | 511 | 2600 | Negative | | |
| AGGTTTGGTACAGCAACAGGAGGGA | 512 | 2601 | Negative | | |
| ACAGCAACAGGAGGGATACATAGAG | 513 | 2610 | Negative | | |
| GAGGGATACATAGAGGTTCCTTGAG | 514 | 2620 | Negative | | |
| GCATGGTCCCGTGCTGGTGGTTGAG | 515 | 2664 | Negative | | |
| ATGGTCCCGTGCTGGTGGTTGAGGA | 516 | 2666 | Negative | | |
| CGTGCTGGTGGTTGAGGATCCTGGA | 517 | 2673 | Negative | | |
| GTGCTGGTGGTTGAGGATCCTGGAA | 518 | 2674 | Negative | | |
| GTGGTTGAGGATCCTGGAATTAGAG | 519 | 2680 | Negative | | |
| GGTTGAGGATCCTGGAATTAGAGGA | 520 | 2682 | Negative | | |
| ATCCTGGAATTAGAGGACAAACGGG | 521 | 2690 | Negative | | |
| GGCAACATACCTTGATAGTCCAGAA | 522 | 2713 | Negative | | |
| AACATACCTTGATAGTCCAGAAGAA | 523 | 2716 | Negative | | |
| GATAGTCCAGAAGAACCAACAAGAA | 524 | 2726 | Negative | | |
| CCAGAAGAACCAACAAGAAGATGAG | 525 | 2732 | Negative | | |
| AAGAAGATGAGGCATAGCAGCAGGA | 526 | 2746 | Negative | | |
| AGATGAGGCATAGCAGCAGGATGAA | 527 | 2750 | Negative | | |
| TGAGGCATAGCAGCAGGATGAAGAG | 528 | 2753 | Negative | | |
| AGGCATAGCAGCAGGATGAAGAGGA | 529 | 2755 | Negative | | |
| GGCATAGCAGCAGGATGAAGAGGAA | 530 | 2756 | Negative | | |
| CAGACACATCCAGCGATAACCAGGA | 531 | 2796 | Negative | | |
| CCAGCGATAACCAGGACAAGTTGGA | 532 | 2805 | Negative | | |
| CAGCGATAACCAGGACAAGTTGGAG | 533 | 2806 | Negative | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| GCGATAACCAGGACAAGTTGGAGGA | 534 | 2808 | Negative | | |
| AACCAGGACAAGTTGGAGGACAGGA | 535 | 2813 | Negative | | |
| ACCAGGACAAGTTGGAGGACAGGAG | 536 | 2814 | Negative | | |
| AGTTGGAGGACAGGAGGTTGGTGAG | 537 | 2823 | Negative | | |
| GACAGGAGGTTGGTGAGTGATTGGA | 538 | 2831 | Negative | | |
| ACAGGAGGTTGGTGAGTGATTGGAG | 539 | 2832 | Negative | | |
| GGTTGGTGAGTGATTGGAGGTTGGG | 540 | 2838 | Negative | | |
| GTTGGTGAGTGATTGGAGGTTGGGG | 541 | 2839 | Negative | | |
| TTGGTGAGTGATTGGAGGTTGGGGA | 542 | 2840 | Negative | | |
| GTGATTGGAGGTTGGGGACTGCGAA | 543 | 2847 | Negative | | |
| AGACACGGTAGTTCCCCCTAGAA | 544 | 2881 | Negative | | |
| CGGTAGTTCCCCCTAGAAAATTGAG | 545 | 2888 | Negative | | |
| GTAGTTCCCCCTAGAAAATTGAGAG | 546 | 2890 | Negative | | |
| AGTTCCCCCTAGAAAATTGAGAGAA | 547 | 2892 | Negative | | |
| AAAATTGAGAGAAGTCCACCACGAG | 548 | 2904 | Negative | | |
| AGTCTAGACTCTGCGGTATTGTGAG | 549 | 2927 | Negative | | |
| TCTAGACTCTGCGGTATTGTGAGGA | 550 | 2929 | Negative | | |
| TTGTGAGGATTCTTGTCAACAAGAA | 551 | 2945 | Negative | | |
| AGAAAAACCCCGCCTGTAACACGAG | 552 | 2966 | Negative | | |
| AAAAACCCCGCCTGTAACACGAGAA | 553 | 2968 | Negative | | |
| AACCCCGCCTGTAACACGAGAAGGG | 554 | 2971 | Negative | | |
| ACCCCGCCTGTAACACGAGAAGGGG | 555 | 2972 | Negative | | |
| TGTAACACGAGAAGGGGTCCTAGGA | 556 | 2980 | Negative | | |
| GTAACACGAGAAGGGGTCCTAGGAA | 557 | 2981 | Negative | | |
| GATGTTCTCCATGTTCAGCGCAGGG | 558 | 3015 | Negative | | |
| CAGCGCAGGGTCCCCAATCCTCGAG | 559 | 3030 | Negative | | |
| GCGCAGGGTCCCCAATCCTCGAGAA | 560 | 3032 | Negative | | |
| TCCTCGAGAAGATTGACGATAAGGG | 561 | 3047 | Negative | | |
| CCTCGAGAAGATTGACGATAAGGGA | 562 | 3048 | Negative | | |
| CTCGAGAAGATTGACGATAAGGGAG | 563 | 3049 | Negative | | |
| CGAGAAGATTGACGATAAGGGAGAG | 564 | 3051 | Negative | | |
| CGATAAGGGAGAGGCAGTAGTCGGA | 565 | 3063 | Negative | | |
| GATAAGGGAGAGGCAGTAGTCGGAA | 566 | 3064 | Negative | | |
| GGGAGAGGCAGTAGTCGGAACAGGG | 567 | 3069 | Negative | | |
| CGGAACAGGGTTTACTGCTCCTGAA | 568 | 3084 | Negative | | |
| CAGGGTTTACTGCTCCTGAACTGGA | 569 | 3089 | Negative | | |
| AGGGTTTACTGCTCCTGAACTGGAG | 570 | 3090 | Negative | | |
| TCCTGAACTGGAGCCACCAGCAGGG | 571 | 3102 | Negative | | |

TABLE 6-continued

SaCas9 sgRNAs

| 20 nt guide + 5 nt PAM | SEQ ID NO: | nt Start | Sense | Core? | Close to G17? |
|---|---|---|---|---|---|
| CCTGAACTGGAGCCACCAGCAGGGA | 572 | 3103 | Negative | | |
| CTGAACTGGAGCCACCAGCAGGGAA | 573 | 3104 | Negative | | |
| GGAAATACAGGCCTCTCACTCTGGG | 574 | 3125 | Negative | | |
| GAAATACAGGCCTCTCACTCTGGGA | 575 | 3126 | Negative | | |

TABLE 7

SpCas9 sgRNAs

| 20 nt guide + 3 nt PAM | SEQ ID NO: | nt Start | Sense | Core? | Close to G17? |
|---|---|---|---|---|---|
| AACCTTTCACCAAACTCTGCAAG | 576 | 7 | Positive | | |
| CACCAAACTCTGCAAGATCCCAG | 577 | 14 | Positive | | |
| CCAAACTCTGCAAGATCCCAGAG | 578 | 16 | Positive | | |
| ACTCTGCAAGATCCCAGAGTGAG | 579 | 20 | Positive | | |
| TCTGCAAGATCCCAGAGTGAGAG | 580 | 22 | Positive | | |
| CTGCAAGATCCCAGAGTGAGAGG | 581 | 23 | Positive | | |
| AGAGGCCTGTATTTCCCTGCTGG | 582 | 41 | Positive | | |
| GGCCTGTATTTCCCTGCTGGTGG | 583 | 44 | Positive | | |
| TATTTCCCTGCTGGTGGCTCCAG | 584 | 50 | Positive | | |
| CCCTGCTGGTGGCTCCAGTTCAG | 585 | 55 | Positive | | |
| CCTGCTGGTGGCTCCAGTTCAGG | 586 | 56 | Positive | | |
| TGCTGGTGGCTCCAGTTCAGGAG | 587 | 58 | Positive | | |
| TGGTGGCTCCAGTTCAGGAGCAG | 588 | 61 | Positive | | |
| CCCTTATCGTCAATCTTCTCGAG | 589 | 110 | Positive | | |
| CCTTATCGTCAATCTTCTCGAGG | 590 | 111 | Positive | | |
| TCGTCAATCTTCTCGAGGATTGG | 591 | 116 | Positive | | |
| CGTCAATCTTCTCGAGGATTGGG | 592 | 117 | Positive | | |
| GTCAATCTTCTCGAGGATTGGGG | 593 | 118 | Positive | | |
| TGGGACCCTGCGCTGAACATGG | 594 | 136 | Positive | | |
| GGGACCCTGCGCTGAACATGGAG | 595 | 138 | Positive | | |
| GAACATGGAGAACATCACATCAG | 596 | 151 | Positive | | |
| AACATGGAGAACATCACATCAGG | 597 | 152 | Positive | | |
| GAACATCACATCAGGATTCCTAG | 598 | 160 | Positive | | |
| AACATCACATCAGGATTCCTAGG | 599 | 161 | Positive | | |
| TAGGACCCCTTCTCGTGTTACAG | 600 | 180 | Positive | | |
| AGGACCCCTTCTCGTGTTACAGG | 601 | 181 | Positive | | |
| ACCCCTTCTCGTGTTACAGGCGG | 602 | 184 | Positive | | |
| CCCCTTCTCGTGTTACAGGCGGG | 603 | 185 | Positive | | |
| CCCTTCTCGTGTTACAGGCGGGG | 604 | 186 | Positive | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| GCGGGGTTTTCTTGTTGACAAG | 605 | 203 | Positive | | |
| CAAGAATCCTCACAATACCGCAG | 606 | 222 | Positive | | |
| AGAATCCTCACAATACCGCAGAG | 607 | 224 | Positive | | |
| CCTCACAATACCGCAGAGTCTAG | 608 | 229 | Positive | | |
| TACCGCAGAGTCTAGACTCGTGG | 609 | 237 | Positive | | |
| CGCAGAGTCTAGACTCGTGGTGG | 610 | 240 | Positive | | |
| GTGGACTTCTCTCAATTTTCTAG | 611 | 259 | Positive | | |
| TGGACTTCTCTCAATTTTCTAGG | 612 | 260 | Positive | | |
| GGACTTCTCTCAATTTTCTAGGG | 613 | 261 | Positive | | |
| GACTTCTCTCAATTTTCTAGGGG | 614 | 262 | Positive | | |
| ACTTCTCTCAATTTTCTAGGGGG | 615 | 263 | Positive | | |
| GGGGGAACTACCGTGTGTCTTGG | 616 | 281 | Positive | | |
| TGTGTCTTGGCCAAAATTCGCAG | 617 | 294 | Positive | | |
| TCCTGTCCTCCAACTTGTCCTGG | 618 | 344 | Positive | | |
| CAACTTGTCCTGGTTATCGCTGG | 619 | 354 | Positive | | |
| GTTATCGCTGGATGTGTCTGCGG | 620 | 366 | Positive | | |
| GCTATGCCTCATCTTCTTGTTGG | 621 | 418 | Positive | | |
| CATCTTCTTGTTGGTTCTTCTGG | 622 | 427 | Positive | | |
| GTTGGTTCTTCTGGACTATCAAG | 623 | 436 | Positive | | |
| TTGGTTCTTCTGGACTATCAAGG | 624 | 437 | Positive | | |
| GCCCGTTTGTCCTCTAATTCCAG | 625 | 466 | Positive | | |
| CCCGTTTGTCCTCTAATTCCAGG | 626 | 467 | Positive | | |
| ATTCCAGGATCCTCAACCACCAG | 627 | 482 | Positive | | |
| AGGATCCTCAACCACCAGCACGG | 628 | 487 | Positive | | |
| GGATCCTCAACCACCAGCACGGG | 629 | 488 | Positive | | |
| AACCTGCATGACTACTGCTCAAG | 630 | 520 | Positive | | |
| ACCTGCATGACTACTGCTCAAGG | 631 | 521 | Positive | | |
| CTGTTGCTGTACCAAACCTTCGG | 632 | 562 | Positive | | |
| TGCTGTACCAAACCTTCGGACGG | 633 | 566 | Positive | | |
| GTATTCCCATCCCATCATCCTGG | 634 | 600 | Positive | | |
| TATTCCCATCCCATCATCCTGGG | 635 | 601 | Positive | | |
| ATCCCATCATCCTGGGCTTTCGG | 636 | 608 | Positive | | |
| GGGCTTTCGGAAAATTCCTATGG | 637 | 621 | Positive | | |
| GGCTTTCGGAAAATTCCTATGGG | 638 | 622 | Positive | | |
| CTTTCGGAAAATTCCTATGGGAG | 639 | 624 | Positive | | |
| TCGGAAAATTCCTATGGGAGTGG | 640 | 627 | Positive | | |
| CGGAAAATTCCTATGGGAGTGGG | 641 | 628 | Positive | | |
| ATTCCTATGGGAGTGGGCCTCAG | 642 | 634 | Positive | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| GGGCCTCAGCCCGTTTCTCCTGG | 643 | 648 | Positive | | |
| TCAGCCCGTTTCTCCTGGCTCAG | 644 | 653 | Positive | | |
| TTTCTCCTGGCTCAGTTTACTAG | 645 | 661 | Positive | | |
| GTTTACTAGTGCCATTTGTTCAG | 646 | 675 | Positive | | |
| TACTAGTGCCATTTGTTCAGTGG | 647 | 678 | Positive | | |
| GCCATTTGTTCAGTGGTTCGTAG | 648 | 685 | Positive | | |
| CCATTTGTTCAGTGGTTCGTAGG | 649 | 686 | Positive | | |
| CATTTGTTCAGTGGTTCGTAGGG | 650 | 687 | Positive | | |
| TAGGGCTTTCCCCCACTGTTTGG | 651 | 705 | Positive | | |
| TTCCCCCACTGTTTGGCTTTCAG | 652 | 712 | Positive | | |
| CTGTTTGGCTTTCAGTTATATGG | 653 | 720 | Positive | | |
| TTTCAGTTATATGGATGATGTGG | 654 | 729 | Positive | | |
| TTATATGGATGATGTGGTATTGG | 655 | 735 | Positive | | |
| TATATGGATGATGTGGTATTGGG | 656 | 736 | Positive | | |
| ATATGGATGATGTGGTATTGGGG | 657 | 737 | Positive | | |
| TATGGATGATGTGGTATTGGGGG | 658 | 738 | Positive | | |
| ATGATGTGGTATTGGGGCCAAG | 659 | 743 | Positive | | |
| TATTGGGGCCAAGTCTGTACAG | 660 | 752 | Positive | | |
| CCAAGTCTGTACAGCATCTTGAG | 661 | 761 | Positive | | |
| TACCAATTTTCTTTTGTCTTTGG | 662 | 801 | Positive | | |
| ACCAATTTTCTTTTGTCTTTGGG | 663 | 802 | Positive | | |
| ATTTAAACCCTAACAAAACAAAG | 664 | 830 | Positive | | |
| TTAAACCCTAACAAAACAAAGAG | 665 | 832 | Positive | | |
| ACCCTAACAAAACAAAGAGATGG | 666 | 836 | Positive | | |
| CCCTAACAAAACAAAGAGATGGG | 667 | 837 | Positive | | |
| CCTAACAAAACAAAGAGATGGGG | 668 | 838 | Positive | | |
| GGGTTACTCTCTGAATTTTATGG | 669 | 858 | Positive | | |
| GGTTACTCTCTGAATTTTATGGG | 670 | 859 | Positive | | |
| AATTTTATGGGTTATGTCATTGG | 671 | 871 | Positive | | |
| TTTATGGGTTATGTCATTGGAAG | 672 | 874 | Positive | | |
| GGTTATGTCATTGGAAGTTATGG | 673 | 880 | Positive | | |
| GTTATGTCATTGGAAGTTATGGG | 674 | 881 | Positive | | |
| AAGTTATGGGTCCTTGCCACAAG | 675 | 894 | Positive | | |
| ACACATCATACAAAAAATCAAAG | 676 | 918 | Positive | | |
| CAAAAAATCAAAGAATGTTTTAG | 677 | 928 | Positive | | |
| TTTAGAAAACTTCCTATTAACAG | 678 | 946 | Positive | | |
| TTAGAAAACTTCCTATTAACAGG | 679 | 947 | Positive | | |
| CTATTAACAGGCCTATTGATTGG | 680 | 959 | Positive | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| TAACAGGCCTATTGATTGGAAAG | 681 | 963 | Positive | | |
| GAAAGTATGTCAACGAATTGTGG | 682 | 981 | Positive | | |
| AAAGTATGTCAACGAATTGTGGG | 683 | 982 | Positive | | |
| TCAACGAATTGTGGGTCTTTTGG | 684 | 990 | Positive | | |
| CAACGAATTGTGGGTCTTTTGGG | 685 | 991 | Positive | | |
| GCTGCCCCATTTACACAATGTGG | 686 | 1018 | Positive | | |
| TGTATGCATGTATTCAATCTAAG | 687 | 1061 | Positive | | |
| ATGCATGTATTCAATCTAAGCAG | 688 | 1064 | Positive | | |
| TGCATGTATTCAATCTAAGCAGG | 689 | 1065 | Positive | | |
| TCACTTTCTCGCCAACTTACAAG | 690 | 1091 | Positive | | |
| CACTTTCTCGCCAACTTACAAGG | 691 | 1092 | Positive | | |
| TGAACCTTTACCCCGTTGCCCGG | 692 | 1136 | Positive | | |
| TTTACCCCGTTGCCCGGCAACGG | 693 | 1142 | Positive | | |
| CCCCGTTGCCCGGCAACGGCCAG | 694 | 1146 | Positive | | |
| CCCGTTGCCCGGCAACGGCCAGG | 695 | 1147 | Positive | | |
| GCAACGGCCAGGTCTGTGCCAAG | 696 | 1158 | Positive | | |
| TTTGCTGACGCAACCCCCACTGG | 697 | 1183 | Positive | | |
| CTGACGCAACCCCCACTGGCTGG | 698 | 1187 | Positive | | |
| TGACGCAACCCCCACTGGCTGGG | 699 | 1188 | Positive | | |
| GACGCAACCCCCACTGGCTGGGG | 700 | 1189 | Positive | | |
| AACCCCCACTGGCTGGGCTTGG | 701 | 1194 | Positive | | |
| CACTGGCTGGGGCTTGGTCATGG | 702 | 1200 | Positive | | |
| ACTGGCTGGGGCTTGGTCATGGG | 703 | 1201 | Positive | | |
| GGGGCTTGGTCATGGGCCATCAG | 704 | 1208 | Positive | | |
| ATGGGCCATCAGCGCGTGCGTGG | 705 | 1219 | Positive | | |
| GCGCGTGCGTGGAACCTTTTCGG | 706 | 1230 | Positive | | |
| TCCTCTGCCGATCCATACTGCGG | 707 | 1254 | Positive | | |
| GATCCATACTGCGGAACTCCTAG | 708 | 1263 | Positive | | |
| CTAGCCGCTTGTTTTGCTCGCAG | 709 | 1282 | Positive | | |
| GCCGCTTGTTTTGCTCGCAGCAG | 710 | 1285 | Positive | | |
| CCGCTTGTTTTGCTCGCAGCAGG | 711 | 1286 | Positive | | |
| TGTTTTGCTCGCAGCAGGTCTGG | 712 | 1291 | Positive | | |
| TTTTGCTCGCAGCAGGTCTGGAG | 713 | 1293 | Positive | | |
| AGGTCTGGAGCAAACATTATCGG | 714 | 1306 | Positive | | |
| GGTCTGGAGCAAACATTATCGGG | 715 | 1307 | Positive | | |
| GCAAATATACATCGTATCCATGG | 716 | 1355 | Positive | | |
| TACATCGTATCCATGGCTGCTAG | 717 | 1362 | Positive | | |
| ACATCGTATCCATGGCTGCTAGG | 718 | 1363 | Positive | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| TGCTAGGCTGTGCTGCCAACTGG | 719 | 1379 | Positive | | |
| GCTGCCAACTGGATCCTGCGCGG | 720 | 1390 | Positive | | |
| CTGCCAACTGGATCCTGCGCGGG | 721 | 1391 | Positive | | |
| GTCCTTTGTTTACGTCCCGTCGG | 722 | 1416 | Positive | | |
| CCCGTCGGCGCTGAATCCTGCGG | 723 | 1431 | Positive | | |
| ATCCTGCGGACGACCCTTCTCGG | 724 | 1445 | Positive | | |
| TCCTGCGGACGACCCTTCTCGGG | 725 | 1446 | Positive | | |
| CCTGCGGACGACCCTTCTCGGGG | 726 | 1447 | Positive | | |
| CGACCCTTCTCGGGGTCGCTTGG | 727 | 1455 | Positive | | |
| GACCCTTCTCGGGGTCGCTTGGG | 728 | 1456 | Positive | | |
| TCTGCCGTTCCGACCGACCACGG | 729 | 1500 | Positive | | |
| CTGCCGTTCCGACCGACCACGGG | 730 | 1501 | Positive | | |
| TGCCGTTCCGACCGACCACGGGG | 731 | 1502 | Positive | | |
| GGGGCGCACCTCTCTTTACGCGG | 732 | 1521 | Positive | | |
| GTCTGTGCCTTCTCATCTGCCGG | 733 | 1551 | Positive | | |
| CTTCACCTCTGCACGTCGCATGG | 734 | 1589 | Positive | | |
| TCACCTCTGCACGTCGCATGGAG | 735 | 1591 | Positive | | |
| ACGCCCACCGAATGTTGCCCAAG | 736 | 1624 | Positive | | |
| CGCCCACCGAATGTTGCCCAAGG | 737 | 1625 | Positive | | |
| TGTTGCCCAAGGTCTTACATAAG | 738 | 1636 | Positive | | |
| TTGCCCAAGGTCTTACATAAGAG | 739 | 1638 | Positive | | |
| TGCCCAAGGTCTTACATAAGAGG | 740 | 1639 | Positive | | |
| GTCTTACATAAGAGGACTCTTGG | 741 | 1647 | Positive | | |
| CAATGTCAACGACCGACCTTGAG | 742 | 1678 | Positive | | |
| AATGTCAACGACCGACCTTGAGG | 743 | 1679 | Positive | | |
| CGACCTTGAGGCATACTTCAAAG | 744 | 1691 | Positive | | |
| CTTCAAAGACTGTTTGTTTAAAG | 745 | 1706 | Positive | | |
| AAGACTGTTTGTTTAAAGACTGG | 746 | 1711 | Positive | | |
| AGACTGTTTGTTTAAAGACTGGG | 747 | 1712 | Positive | | |
| ACTGTTTGTTTAAAGACTGGGAG | 748 | 1714 | Positive | | |
| CTGTTTGTTTAAAGACTGGGAGG | 749 | 1715 | Positive | | |
| GTTTGTTTAAAGACTGGGAGGAG | 750 | 1717 | Positive | | |
| GTTTAAAGACTGGGAGGAGTTGG | 751 | 1721 | Positive | | |
| TTTAAAGACTGGGAGGAGTTGGG | 752 | 1722 | Positive | | |
| TTAAAGACTGGGAGGAGTTGGGG | 753 | 1723 | Positive | | |
| TAAAGACTGGGAGGAGTTGGGGG | 754 | 1724 | Positive | | |
| AAGACTGGGAGGAGTTGGGGGAG | 755 | 1726 | Positive | | |
| AGACTGGGAGGAGTTGGGGGAGG | 756 | 1727 | Positive | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| ACTGGGAGGAGTTGGGGAGGAG | 757 | 1729 | Positive | | |
| GAGGAGTTGGGGAGGAGATTAG | 758 | 1734 | Positive | | |
| TGGGGAGGAGATTAGATTAAAG | 759 | 1741 | Positive | | |
| GGGGGAGGAGATTAGATTAAGG | 760 | 1742 | Positive | | |
| TAGATTAAAGGTCTTTGTACTAG | 761 | 1754 | Positive | | |
| AGATTAAAGGTCTTTGTACTAGG | 762 | 1755 | Positive | | |
| ATTAAAGGTCTTTGTACTAGGAG | 763 | 1757 | Positive | | |
| TTAAAGGTCTTTGTACTAGGAGG | 764 | 1758 | Positive | | |
| GTCTTTGTACTAGGAGGCTGTAG | 765 | 1764 | Positive | | |
| TCTTTGTACTAGGAGGCTGTAGG | 766 | 1765 | Positive | | |
| AGGAGGCTGTAGGCATAAATTGG | 767 | 1775 | Positive | | |
| GCATAAATTGGTCTGCGCACCAG | 768 | 1787 | Positive | | |
| TTGTTCATGTCCTACTGTTCAAG | 769 | 1846 | Positive | Yes | |
| GTCCTACTGTTCAAGCCTCCAAG | 770 | 1854 | Positive | Yes | |
| CAAGCCTCCAAGCTGTGCCTTGG | 771 | 1865 | Positive | Yes | |
| AAGCCTCCAAGCTGTGCCTTGGG | 772 | 1866 | Positive | Yes | |
| CCTCCAAGCTGTGCCTTGGGTGG | 773 | 1869 | Positive | Yes | |
| AGCTGTGCCTTGGGTGGCTTTGG | 774 | 1875 | Positive | Yes | Yes |
| GCTGTGCCTTGGGTGGCTTTGGG | 775 | 1876 | Positive | Yes | Yes |
| CTGTGCCTTGGGTGGCTTTGGGG | 776 | 1877 | Positive | Yes | Yes |
| CCTTGGGTGGCTTTGGGGCATGG | 777 | 1882 | Positive | Yes | Yes |
| CATGGACATCGACCCTTATAAAG | 778 | 1900 | Positive | Yes | Yes |
| ATCGACCCTTATAAAGAATTTGG | 779 | 1907 | Positive | Yes | Yes |
| CGACCCTTATAAAGAATTTGGAG | 780 | 1909 | Positive | Yes | Yes |
| TAAAGAATTTGGAGCTACTGTGG | 781 | 1918 | Positive | Yes | Yes |
| AAGAATTTGGAGCTACTGTGGAG | 782 | 1920 | Positive | Yes | Yes |
| GCCTTCTGACTTCTTTCCTTCAG | 783 | 1957 | Positive | Yes | Yes |
| TGACTTCTTTCCTTCAGTACGAG | 784 | 1963 | Positive | Yes | Yes |
| TCCTTCAGTACGAGATCTTCTAG | 785 | 1972 | Positive | Yes | |
| AGATCTTCTAGATACCGCCTCAG | 786 | 1984 | Positive | Yes | |
| ATACCGCCTCAGCTCTGTATCGG | 787 | 1995 | Positive | Yes | |
| TACCGCCTCAGCTCTGTATCGGG | 788 | 1996 | Positive | Yes | |
| CGCCTCAGCTCTGTATCGGGAAG | 789 | 1999 | Positive | Yes | |
| AGCTCTGTATCGGGAAGCCTTAG | 790 | 2005 | Positive | Yes | |
| CTCTGTATCGGGAAGCCTTAGAG | 791 | 2007 | Positive | Yes | |
| GGGAAGCCTTAGAGTCTCCTGAG | 792 | 2016 | Positive | Yes | |
| TCACCTCACCATACTGCACTCAG | 793 | 2045 | Positive | Yes | |
| CACCTCACCATACTGCACTCAGG | 794 | 2046 | Positive | Yes | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| TCACCATACTGCACTCAGGCAAG | 795 | 2050 | Positive | Yes | |
| TCAGGCAAGCAATTCTTTGCTGG | 796 | 2064 | Positive | Yes | |
| CAGGCAAGCAATTCTTTGCTGGG | 797 | 2065 | Positive | Yes | |
| AGGCAAGCAATTCTTTGCTGGGG | 798 | 2066 | Positive | Yes | |
| GGCAAGCAATTCTTTGCTGGGGG | 799 | 2067 | Positive | Yes | |
| GCAAGCAATTCTTTGCTGGGGGG | 800 | 2068 | Positive | Yes | |
| CTGGGGGGAACTAATGACTCTAG | 801 | 2083 | Positive | Yes | |
| AACTAATGACTCTAGCTACCTGG | 802 | 2091 | Positive | Yes | |
| ACTAATGACTCTAGCTACCTGGG | 803 | 2092 | Positive | Yes | |
| AATGACTCTAGCTACCTGGGTGG | 804 | 2095 | Positive | Yes | |
| ATGACTCTAGCTACCTGGGTGGG | 805 | 2096 | Positive | Yes | |
| TACCTGGGTGGGTGTTAATTTGG | 806 | 2107 | Positive | Yes | |
| CTGGGTGGGTGTTAATTTGGAAG | 807 | 2110 | Positive | Yes | |
| GGGTGTTAATTTGGAAGATCCAG | 808 | 2116 | Positive | Yes | |
| AATTTGGAAGATCCAGCATCTAG | 809 | 2123 | Positive | Yes | |
| TTTGGAAGATCCAGCATCTAGAG | 810 | 2125 | Positive | Yes | |
| AGATCCAGCATCTAGAGACCTAG | 811 | 2131 | Positive | Yes | |
| TCCAGCATCTAGAGACCTAGTAG | 812 | 2134 | Positive | Yes | |
| GCATCTAGAGACCTAGTAGTCAG | 813 | 2138 | Positive | Yes | |
| CAGTTATGTCAACACTAATATGG | 814 | 2158 | Positive | Yes | |
| AGTTATGTCAACACTAATATGGG | 815 | 2159 | Positive | Yes | |
| TCAACACTAATATGGGCCTAAAG | 816 | 2166 | Positive | Yes | |
| ACTAATATGGGCCTAAAGTTCAG | 817 | 2171 | Positive | Yes | |
| CTAATATGGGCCTAAAGTTCAGG | 818 | 2172 | Positive | Yes | |
| TAAAGTTCAGGCAACTCTTGTGG | 819 | 2184 | Positive | Yes | |
| CACATTTCTTGTCTCACTTTTGG | 820 | 2210 | Positive | Yes | |
| ATTTCTTGTCTCACTTTTGGAAG | 821 | 2213 | Positive | Yes | |
| TTCTTGTCTCACTTTTGGAAGAG | 822 | 2215 | Positive | Yes | |
| TTTTGGAAGAGAAACCGTTATAG | 823 | 2227 | Positive | Yes | |
| TTGGAAGAGAAACCGTTATAGAG | 824 | 2229 | Positive | Yes | |
| AGAAACCGTTATAGAGTATTTGG | 825 | 2236 | Positive | Yes | |
| ATAGAGTATTTGGTGTCTTTCGG | 826 | 2246 | Positive | Yes | |
| AGAGTATTTGGTGTCTTTCGGAG | 827 | 2248 | Positive | Yes | |
| ATTTGGTGTCTTTCGGAGTGTGG | 828 | 2253 | Positive | Yes | |
| AGTGTGGATTCGCACTCCTCCAG | 829 | 2269 | Positive | Yes | |
| ATTCGCACTCCTCCAGCTTATAG | 830 | 2276 | Positive | Yes | |
| CCCTATCCTATCAACACTTCCGG | 831 | 2311 | Positive | Yes | |
| CTTCCGGAAACTACTGTTGTTAG | 832 | 2327 | Positive | Yes | |

TABLE 7-continued

SpCas9 sgRNAs

| 20 nt guide + 3 nt PAM | SEQ ID NO: | nt Start | Sense | Core? Close to G17? |
|---|---|---|---|---|
| AACTACTGTTGTTAGACGACGAG | 833 | 2335 | Positive | Yes |
| ACTACTGTTGTTAGACGACGAGG | 834 | 2336 | Positive | Yes |
| ACTGTTGTTAGACGACGAGGCAG | 835 | 2339 | Positive | Yes |
| CTGTTGTTAGACGACGAGGCAGG | 836 | 2340 | Positive | Yes |
| AGACGACGAGGCAGGTCCCCTAG | 837 | 2348 | Positive | Yes |
| CGACGAGGCAGGTCCCCTAGAAG | 838 | 2351 | Positive | Yes |
| CGAGGCAGGTCCCCTAGAAGAAG | 839 | 2354 | Positive | Yes |
| AGAAGAACTCCCTCGCCTCGCAG | 840 | 2372 | Positive | Yes |
| ACTCCCTCGCCTCGCAGACGAAG | 841 | 2378 | Positive | Yes |
| CTCCCTCGCCTCGCAGACGAAGG | 842 | 2379 | Positive | Yes |
| AGGTCTCAATCGCCGCGTCGCAG | 843 | 2399 | Positive | Yes |
| TCTCAATCGCCGCGTCGCAGAAG | 844 | 2402 | Positive | Yes |
| GTCGCAGAAGATCTCAATCTCGG | 845 | 2415 | Positive | Yes |
| TCGCAGAAGATCTCAATCTCGGG | 846 | 2416 | Positive | Yes |
| AATCTCGGGAACCTCAATGTTAG | 847 | 2430 | Positive | Yes |
| ACCTCAATGTTAGTATTCCTTGG | 848 | 2440 | Positive | |
| TTAGTATTCCTTGGACTCATAAG | 849 | 2449 | Positive | |
| TAGTATTCCTTGGACTCATAAGG | 850 | 2450 | Positive | |
| TATTCCTTGGACTCATAAGGTGG | 851 | 2453 | Positive | |
| ATTCCTTGGACTCATAAGGTGGG | 852 | 2454 | Positive | |
| TTCCTTGGACTCATAAGGTGGGG | 853 | 2455 | Positive | |
| CATAAGGTGGGAACTTTACTGG | 854 | 2466 | Positive | |
| TACCTGTCTTTAATCCTCATTGG | 855 | 2506 | Positive | |
| TCCTAATATACATTTACACCAAG | 856 | 2543 | Positive | |
| ACATTATCAAAAATGTGAACAG | 857 | 2566 | Positive | |
| CAAAAAATGTGAACAGTTTGTAG | 858 | 2573 | Positive | |
| AAAAAATGTGAACAGTTTGTAGG | 859 | 2574 | Positive | |
| ACAGTTTGTAGGCCCACTTACAG | 860 | 2585 | Positive | |
| TAGGCCCACTTACAGTTAATGAG | 861 | 2593 | Positive | |
| CCACTTACAGTTAATGAGAAAAG | 862 | 2598 | Positive | |
| CTTACAGTTAATGAGAAAAGAAG | 863 | 2601 | Positive | |
| TTGCAATTGATTATGCCTGCTAG | 864 | 2625 | Positive | |
| TGCAATTGATTATGCCTGCTAGG | 865 | 2626 | Positive | |
| TGCCTGCTAGGTTTTATCCAAAG | 866 | 2638 | Positive | |
| GCCTGCTAGGTTTTATCCAAAGG | 867 | 2639 | Positive | |
| GGTTACCAAATATTTACCATTGG | 868 | 2660 | Positive | |
| CCAAATATTTACCATTGGATAAG | 869 | 2665 | Positive | |
| CAAATATTTACCATTGGATAAGG | 870 | 2666 | Positive | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| AAATATTTACCATTGGATAAGGG | 871 | 2667 | Positive | | |
| GGGTATTAAACCTTATTATCCAG | 872 | 2687 | Positive | | |
| ACCTTATTATCCAGAACATCTAG | 873 | 2696 | Positive | | |
| GTTAATCATTACTTCCAAACTAG | 874 | 2718 | Positive | | |
| GACACTATTTACACACTCTATGG | 875 | 2740 | Positive | | |
| ACTATTTACACACTCTATGGAAG | 876 | 2743 | Positive | | |
| CTATTTACACACTCTATGGAAGG | 877 | 2744 | Positive | | |
| TTTACACACTCTATGGAAGGCGG | 878 | 2747 | Positive | | |
| TTACACACTCTATGGAAGGCGGG | 879 | 2748 | Positive | | |
| GGAAGGCGGGTATATTATATAAG | 880 | 2761 | Positive | | |
| AAGGCGGGTATATTATATAAGAG | 881 | 2763 | Positive | | |
| GGCGGGTATATTATATAAGAGAG | 882 | 2765 | Positive | | |
| TATAAGAGAGAAACAACACATAG | 883 | 2778 | Positive | | |
| ACACATAGCGCCTCATTTTGTGG | 884 | 2793 | Positive | | |
| CACATAGCGCCTCATTTTGTGGG | 885 | 2794 | Positive | | |
| TTTGTGGGTCACCATATTCTTGG | 886 | 2809 | Positive | | |
| TTGTGGGTCACCATATTCTTGGG | 887 | 2810 | Positive | | |
| GTCACCATATTCTTGGGAACAAG | 888 | 2816 | Positive | | |
| ATTCTTGGGAACAAGATCTACAG | 889 | 2824 | Positive | | |
| TGGGAACAAGATCTACAGCATGG | 890 | 2829 | Positive | | |
| GGGAACAAGATCTACAGCATGGG | 891 | 2830 | Positive | | |
| GGAACAAGATCTACAGCATGGGG | 892 | 2831 | Positive | | |
| ACAAGATCTACAGCATGGGGCAG | 893 | 2834 | Positive | | |
| ATGGGGCAGAATCTTTCCACCAG | 894 | 2848 | Positive | | |
| TCTTTCCACCAGCAATCCTCTGG | 895 | 2859 | Positive | | |
| CTTTCCACCAGCAATCCTCTGGG | 896 | 2860 | Positive | | |
| TGGGATTCTTTCCCGACCACCAG | 897 | 2879 | Positive | | |
| ATTCTTTCCCGACCACCAGTTGG | 898 | 2883 | Positive | | |
| TCCCGACCACCAGTTGGATCCAG | 899 | 2889 | Positive | | |
| CACCAGTTGGATCCAGCCTTCAG | 900 | 2896 | Positive | | |
| CCAGTTGGATCCAGCCTTCAGAG | 901 | 2898 | Positive | | |
| TCCAGCCTTCAGAGCAAACACAG | 902 | 2907 | Positive | | |
| CAGAGCAAACACAGCAAATCCAG | 903 | 2916 | Positive | | |
| CAAACACAGCAAATCCAGATTGG | 904 | 2921 | Positive | | |
| AAACACAGCAAATCCAGATTGGG | 905 | 2922 | Positive | | |
| ATTGGGACTTCAATCCCAACAAG | 906 | 2939 | Positive | | |
| TTGGGACTTCAATCCCAACAAGG | 907 | 2940 | Positive | | |
| TCAATCCCAACAAGGACACCTGG | 908 | 2948 | Positive | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| TCCCAACAAGGACACCTGGCCAG | 909 | 2952 | Positive | | |
| ACACCTGGCCAGACGCCAACAAG | 910 | 2963 | Positive | | |
| CACCTGGCCAGACGCCAACAAGG | 911 | 2964 | Positive | | |
| CTGGCCAGACGCCAACAAGGTAG | 912 | 2967 | Positive | | |
| TGGCCAGACGCCAACAAGGTAGG | 913 | 2968 | Positive | | |
| GCCAGACGCCAACAAGGTAGGAG | 914 | 2970 | Positive | | |
| GACGCCAACAAGGTAGGAGCTGG | 915 | 2974 | Positive | | |
| CGCCAACAAGGTAGGAGCTGGAG | 916 | 2976 | Positive | | |
| AAGGTAGGAGCTGGAGCATTCGG | 917 | 2983 | Positive | | |
| AGGTAGGAGCTGGAGCATTCGGG | 918 | 2984 | Positive | | |
| AGGAGCTGGAGCATTCGGGCTGG | 919 | 2988 | Positive | | |
| GGAGCTGGAGCATTCGGGCTGGG | 920 | 2989 | Positive | | |
| CTGGGTTTCACCCCACCGCACGG | 921 | 3007 | Positive | | |
| GGGTTTCACCCCACCGCACGGAG | 922 | 3009 | Positive | | |
| GGTTTCACCCCACCGCACGGAGG | 923 | 3010 | Positive | | |
| CCCACCGCACGGAGGCCTTTTGG | 924 | 3018 | Positive | | |
| CCACCGCACGGAGGCCTTTTGGG | 925 | 3019 | Positive | | |
| CACCGCACGGAGGCCTTTTGGGG | 926 | 3020 | Positive | | |
| CGCACGGAGGCCTTTTGGGGTGG | 927 | 3023 | Positive | | |
| CACGGAGGCCTTTTGGGGTGGAG | 928 | 3025 | Positive | | |
| GCCTTTTGGGGTGGAGCCCTCAG | 929 | 3032 | Positive | | |
| CCTTTTGGGGTGGAGCCCTCAGG | 930 | 3033 | Positive | | |
| TGGGGTGGAGCCCTCAGGCTCAG | 931 | 3038 | Positive | | |
| GGGGTGGAGCCCTCAGGCTCAGG | 932 | 3039 | Positive | | |
| GGGTGGAGCCCTCAGGCTCAGGG | 933 | 3040 | Positive | | |
| GGGCATACTACAAACTTTGCCAG | 934 | 3060 | Positive | | |
| CTCCTGCCTCCACCAATCGCCAG | 935 | 3092 | Positive | | |
| TGCCTCCACCAATCGCCAGACAG | 936 | 3096 | Positive | | |
| GCCTCCACCAATCGCCAGACAGG | 937 | 3097 | Positive | | |
| TCCACCAATCGCCAGACAGGAAG | 938 | 3100 | Positive | | |
| CCACCAATCGCCAGACAGGAAGG | 939 | 3101 | Positive | | |
| CCAATCGCCAGACAGGAAGGCAG | 940 | 3104 | Positive | | |
| ACCCCGCTGTCTCCACCTTTGAG | 941 | 3130 | Positive | | |
| CTTTGAGAAACACTCATCCTCAG | 942 | 3146 | Positive | | |
| TTTGAGAAACACTCATCCTCAGG | 943 | 3147 | Positive | | |
| ACACTCATCCTCAGGCCATGCAG | 944 | 3155 | Positive | | |
| CTCATCCTCAGGCCATGCAGTGG | 945 | 3158 | Positive | | |
| TTGTGGAATTC | 946 | 3173 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| GAAAGGTTGTGGAATTC | 947 | 3167 | Negative | | |
| TGAAAGGTTGTGGAATTG | 948 | 3166 | Negative | | |
| CCACTGCATGGCCTGAGGATGAG | 949 | -1 | Negative | | |
| CTGAGGATGAGTGTTTCTCAAAG | 950 | 11 | Negative | | |
| TGAGGATGAGTGTTTCTCAAAGG | 951 | 12 | Negative | | |
| GGATGAGTGTTTCTCAAAGGTGG | 952 | 15 | Negative | | |
| ATGAGTGTTTCTCAAAGGTGGAG | 953 | 17 | Negative | | |
| GTGTTTCTCAAAGGTGGAGACAG | 954 | 21 | Negative | | |
| TTTCTCAAAGGTGGAGACAGCGG | 955 | 24 | Negative | | |
| TTCTCAAAGGTGGAGACAGCGGG | 956 | 25 | Negative | | |
| TCTCAAAGGTGGAGACAGCGGGG | 957 | 26 | Negative | | |
| CAAAGGTGGAGACAGCGGGGTAG | 958 | 29 | Negative | | |
| AAAGGTGGAGACAGCGGGGTAGG | 959 | 30 | Negative | | |
| GGGTAGGCTGCCTTCCTGTCTGG | 960 | 46 | Negative | | |
| CTGCCTTCCTGTCTGGCGATTGG | 961 | 53 | Negative | | |
| CCTTCCTGTCTGGCGATTGGTGG | 962 | 56 | Negative | | |
| TTCCTGTCTGGCGATTGGTGGAG | 963 | 58 | Negative | | |
| TCCTGTCTGGCGATTGGTGGAGG | 964 | 59 | Negative | | |
| TGTCTGGCGATTGGTGGAGGCAG | 965 | 62 | Negative | | |
| GTCTGGCGATTGGTGGAGGCAGG | 966 | 63 | Negative | | |
| CTGGCGATTGGTGGAGGCAGGAG | 967 | 65 | Negative | | |
| TGGCGATTGGTGGAGGCAGGAGG | 968 | 66 | Negative | | |
| CGATTGGTGGAGGCAGGAGGCGG | 969 | 69 | Negative | | |
| GAGGCAGGAGGCGGATTTGCTGG | 970 | 78 | Negative | | |
| AGGAGGCGGATTTGCTGGCAAAG | 971 | 83 | Negative | | |
| GGATTTGCTGGCAAAGTTTGTAG | 972 | 90 | Negative | | |
| CAAAGTTTGTAGTATGCCCTGAG | 973 | 101 | Negative | | |
| TTGTAGTATGCCCTGAGCCTGAG | 974 | 107 | Negative | | |
| TGTAGTATGCCCTGAGCCTGAGG | 975 | 108 | Negative | | |
| GTAGTATGCCCTGAGCCTGAGGG | 976 | 109 | Negative | | |
| GCCTGAGGGCTCCACCCCAAAAG | 977 | 123 | Negative | | |
| CCTGAGGGCTCCACCCCAAAAGG | 978 | 124 | Negative | | |
| CACCCCAAAAGGCCTCCGTGCGG | 979 | 135 | Negative | | |
| CCCAAAAGGCCTCCGTGCGGTGG | 980 | 138 | Negative | | |
| CCAAAAGGCCTCCGTGCGGTGGG | 981 | 139 | Negative | | |
| CAAAAGGCCTCCGTGCGGTGGGG | 982 | 140 | Negative | | |
| CCGTGCGGTGGGGTGAAACCCAG | 983 | 150 | Negative | | |
| GAAACCCAGCCCGAATGCTCCAG | 984 | 164 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| TGCTCCAGCTCCTACCTTGTTGG | 985 | 179 | Negative | | |
| GCTCCTACCTTGTTGGCGTCTGG | 986 | 186 | Negative | | |
| CTACCTTGTTGGCGTCTGGCCAG | 987 | 190 | Negative | | |
| TACCTTGTTGGCGTCTGGCCAGG | 988 | 191 | Negative | | |
| GTCTGGCCAGGTGTCCTTGTTGG | 989 | 203 | Negative | | |
| TCTGGCCAGGTGTCCTTGTTGGG | 990 | 204 | Negative | | |
| AGGTGTCCTTGTTGGGATTGAAG | 991 | 211 | Negative | | |
| TTGGGATTGAAGTCCCAATCTGG | 992 | 222 | Negative | | |
| GATTTGCTGTGTTTGCTCTGAAG | 993 | 244 | Negative | | |
| ATTTGCTGTGTTTGCTCTGAAGG | 994 | 245 | Negative | | |
| GCTGTGTTTGCTCTGAAGGCTGG | 995 | 249 | Negative | | |
| CTCTGAAGGCTGGATCCAACTGG | 996 | 259 | Negative | | |
| TGAAGGCTGGATCCAACTGGTGG | 997 | 262 | Negative | | |
| GGCTGGATCCAACTGGTGGTCGG | 998 | 266 | Negative | | |
| GCTGGATCCAACTGGTGGTCGGG | 999 | 267 | Negative | | |
| GATCCAACTGGTGGTCGGGAAAG | 1000 | 271 | Negative | | |
| TGGTGGTCGGGAAAGAATCCCAG | 1001 | 279 | Negative | | |
| GTGGTCGGGAAAGAATCCCAGAG | 1002 | 281 | Negative | | |
| TGGTCGGGAAAGAATCCCAGAGG | 1003 | 282 | Negative | | |
| AAAGAATCCCAGAGGATTGCTGG | 1004 | 290 | Negative | | |
| GAATCCCAGAGGATTGCTGGTGG | 1005 | 293 | Negative | | |
| CCCAGAGGATTGCTGGTGGAAAG | 1006 | 297 | Negative | | |
| AAAGATTCTGCCCCATGCTGTAG | 1007 | 316 | Negative | | |
| ATGCTGTAGATCTTGTTCCCAAG | 1008 | 330 | Negative | | |
| AGATCTTGTTCCCAAGAATATGG | 1009 | 337 | Negative | | |
| AATATGGTGACCCACAAAATGAG | 1010 | 353 | Negative | | |
| ATATGGTGACCCACAAAATGAGG | 1011 | 354 | Negative | | |
| TATAATATACCCGCCTTCCATAG | 1012 | 400 | Negative | | |
| TAATATACCCGCCTTCCATAGAG | 1013 | 402 | Negative | | |
| CCTTCCATAGAGTGTGTAAATAG | 1014 | 413 | Negative | | |
| TAGAGTGTGTAAATAGTGTCTAG | 1015 | 420 | Negative | | |
| TGTGTAAATAGTGTCTAGTTTGG | 1016 | 425 | Negative | | |
| GTAAATAGTGTCTAGTTTGGAAG | 1017 | 428 | Negative | | |
| GTTTGGAAGTAATGATTAACTAG | 1018 | 442 | Negative | | |
| TAATGATTAACTAGATGTTCTGG | 1019 | 451 | Negative | | |
| AACTAGATGTTCTGGATAATAAG | 1020 | 459 | Negative | | |
| ACTAGATGTTCTGGATAATAAGG | 1021 | 460 | Negative | | |
| GGTTTAATACCCTTATCCAATGG | 1022 | 481 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| CTTATCCAATGGTAAATATTTGG | 1023 | 492 | Negative | | |
| GGTAAATATTTGGTAACCTTTGG | 1024 | 502 | Negative | | |
| GGTAACCTTTGGATAAAACCTAG | 1025 | 513 | Negative | | |
| AACCTTTGGATAAAACCTAGCAG | 1026 | 516 | Negative | | |
| ACCTTTGGATAAAACCTAGCAGG | 1027 | 517 | Negative | | |
| CTTCTTTTCTCATTAACTGTAAG | 1028 | 556 | Negative | | |
| CTTTTCTCATTAACTGTAAGTGG | 1029 | 559 | Negative | | |
| TTTTCTCATTAACTGTAAGTGGG | 1030 | 560 | Negative | | |
| CACATTTTTGATAATGTCTTGG | 1031 | 596 | Negative | | |
| GTCTTGGTGTAAATGTATATTAG | 1032 | 612 | Negative | | |
| TCTTGGTGTAAATGTATATTAGG | 1033 | 613 | Negative | | |
| GTGTAAATGTATATTAGGAAAAG | 1034 | 618 | Negative | | |
| AAATGTATATTAGGAAAAGATGG | 1035 | 622 | Negative | | |
| AAAAGATGGTGTTTTCCAATGAG | 1036 | 636 | Negative | | |
| AAAGATGGTGTTTTCCAATGAGG | 1037 | 637 | Negative | | |
| GTGTTTTCCAATGAGGATTAAAG | 1038 | 644 | Negative | | |
| TTTCCAATGAGGATTAAAGACAG | 1039 | 648 | Negative | | |
| TTCCAATGAGGATTAAAGACAGG | 1040 | 649 | Negative | | |
| ATGAGGATTAAAGACAGGTACAG | 1041 | 654 | Negative | | |
| AGGATTAAAGACAGGTACAGTAG | 1042 | 657 | Negative | | |
| ATTAAAGACAGGTACAGTAGAAG | 1043 | 660 | Negative | | |
| ACAGGTACAGTAGAAGAATAAAG | 1044 | 667 | Negative | | |
| TACAGTAGAAGAATAAAGACCAG | 1045 | 672 | Negative | | |
| TAGAAGAATAAAGACCAGTAAAG | 1046 | 677 | Negative | | |
| AGTAAAGTTCCCCACCTTATGAG | 1047 | 693 | Negative | | |
| GTTCCCCACCTTATGAGTCCAAG | 1048 | 699 | Negative | | |
| TTCCCCACCTTATGAGTCCAAGG | 1049 | 700 | Negative | | |
| GTCCAAGGAATACTAACATTGAG | 1050 | 715 | Negative | | |
| TCCAAGGAATACTAACATTGAGG | 1051 | 716 | Negative | | |
| ATACTAACATTGAGGTTCCCGAG | 1052 | 724 | Negative | | |
| ACATTGAGGTTCCCGAGATTGAG | 1053 | 730 | Negative | Yes | |
| GATTGAGATCTTCTGCGACGCGG | 1054 | 746 | Negative | Yes | |
| TCTTCTGCGACGCGGCGATTGAG | 1055 | 754 | Negative | Yes | |
| CGATTGAGACCTTCGTCTGCGAG | 1056 | 769 | Negative | Yes | |
| GATTGAGACCTTCGTCTGCGAGG | 1057 | 770 | Negative | Yes | |
| GAGACCTTCGTCTGCGAGGCGAG | 1058 | 774 | Negative | Yes | |
| AGACCTTCGTCTGCGAGGCGAGG | 1059 | 775 | Negative | Yes | |
| GACCTTCGTCTGCGAGGCGAGGG | 1060 | 776 | Negative | Yes | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| CCTTCGTCTGCGAGGCGAGGGAG | 1061 | 778 | Negative | | Yes |
| AGGCGAGGGAGTTCTTCTTCTAG | 1062 | 790 | Negative | | Yes |
| GGCGAGGGAGTTCTTCTTCTAGG | 1063 | 791 | Negative | | Yes |
| GCGAGGGAGTTCTTCTTCTAGGG | 1064 | 792 | Negative | | Yes |
| CGAGGGAGTTCTTCTTCTAGGGG | 1065 | 793 | Negative | | Yes |
| CCTGCCTCGTCGTCTAACAACAG | 1066 | 817 | Negative | | Yes |
| GCCTCGTCGTCTAACAACAGTAG | 1067 | 820 | Negative | | Yes |
| CGTCTAACAACAGTAGTTTCCGG | 1068 | 827 | Negative | | Yes |
| CTAACAACAGTAGTTTCCGGAAG | 1069 | 830 | Negative | | Yes |
| GTAGTTTCCGGAAGTGTTGATAG | 1070 | 839 | Negative | | Yes |
| TAGTTTCCGGAAGTGTTGATAGG | 1071 | 840 | Negative | | Yes |
| TTCCGGAAGTGTTGATAGGATAG | 1072 | 844 | Negative | | Yes |
| TCCGGAAGTGTTGATAGGATAGG | 1073 | 845 | Negative | | Yes |
| CCGGAAGTGTTGATAGGATAGGG | 1074 | 846 | Negative | | Yes |
| CGGAAGTGTTGATAGGATAGGGG | 1075 | 847 | Negative | | Yes |
| GTTGATAGGATAGGGCATTTGG | 1076 | 854 | Negative | | Yes |
| GATAGGATAGGGGCATTTGGTGG | 1077 | 857 | Negative | | Yes |
| AGGGGCATTTGGTGGTCTATAAG | 1078 | 865 | Negative | | Yes |
| GCATTTGGTGGTCTATAAGCTGG | 1079 | 869 | Negative | | Yes |
| ATTTGGTGGTCTATAAGCTGGAG | 1080 | 871 | Negative | | Yes |
| TTTGGTGGTCTATAAGCTGGAGG | 1081 | 872 | Negative | | Yes |
| TGGTGGTCTATAAGCTGGAGGAG | 1082 | 874 | Negative | | Yes |
| AGTGCGAATCCACACTCCGAAAG | 1083 | 895 | Negative | | Yes |
| AGACACCAAATACTCTATAACGG | 1084 | 916 | Negative | | Yes |
| TATAACGGTTTCTCTTCCAAAAG | 1085 | 931 | Negative | | Yes |
| ACGGTTTCTCTTCCAAAAGTGAG | 1086 | 935 | Negative | | Yes |
| TTCTCTTCCAAAAGTGAGACAAG | 1087 | 940 | Negative | | Yes |
| GACAAGAAATGTGAAACCACAAG | 1088 | 957 | Negative | | Yes |
| CAAGAAATGTGAAACCACAAGAG | 1089 | 959 | Negative | | Yes |
| CACAAGAGTTGCCTGAACTTTAG | 1090 | 974 | Negative | | Yes |
| ACAAGAGTTGCCTGAACTTTAGG | 1091 | 975 | Negative | | Yes |
| CCTGAACTTTAGGCCCATATTAG | 1092 | 985 | Negative | | Yes |
| GTGTTGACATAACTGACTACTAG | 1093 | 1007 | Negative | | Yes |
| TGTTGACATAACTGACTACTAGG | 1094 | 1008 | Negative | | Yes |
| ATAACTGACTACTAGGTCTCTAG | 1095 | 1015 | Negative | | Yes |
| ACTACTAGGTCTCTAGATGCTGG | 1096 | 1022 | Negative | | Yes |
| CTTCCAAATTAACACCCACCCAG | 1097 | 1047 | Negative | | Yes |
| TTCCAAATTAACACCCACCCAGG | 1098 | 1048 | Negative | | Yes |

TABLE 7-continued

SpCas9 sgRNAs

| 20 nt guide + 3 nt PAM | SEQ ID NO: | nt Start | Sense | Core? | Close to G17? |
|---|---|---|---|---|---|
| CAAATTAACACCCACCCAGGTAG | 1099 | 1051 | Negative | Yes | |
| TTAACACCCACCCAGGTAGCTAG | 1100 | 1055 | Negative | Yes | |
| AACACCCACCCAGGTAGCTAGAG | 1101 | 1057 | Negative | Yes | |
| ACCCAGGTAGCTAGAGTCATTAG | 1102 | 1064 | Negative | Yes | |
| CTAGAGTCATTAGTTCCCCCCAG | 1103 | 1074 | Negative | Yes | |
| GTCATTAGTTCCCCCCAGCAAAG | 1104 | 1079 | Negative | Yes | |
| CAGCAAAGAATTGCTTGCCTGAG | 1105 | 1094 | Negative | Yes | |
| AAGAATTGCTTGCCTGAGTGCAG | 1106 | 1099 | Negative | Yes | |
| TTGCTTGCCTGAGTGCAGTATGG | 1107 | 1104 | Negative | Yes | |
| TTGCCTGAGTGCAGTATGGTGAG | 1108 | 1108 | Negative | Yes | |
| TGCCTGAGTGCAGTATGGTGAGG | 1109 | 1109 | Negative | Yes | |
| ATGGTGAGGTGAACAATGCTCAG | 1110 | 1123 | Negative | Yes | |
| TGGTGAGGTGAACAATGCTCAGG | 1111 | 1124 | Negative | Yes | |
| GTGAGGTGAACAATGCTCAGGAG | 1112 | 1126 | Negative | Yes | |
| AACAATGCTCAGGAGACTCTAAG | 1113 | 1134 | Negative | Yes | |
| ACAATGCTCAGGAGACTCTAAGG | 1114 | 1135 | Negative | Yes | |
| GACTCTAAGGCTTCCCGATACAG | 1115 | 1148 | Negative | Yes | |
| CTCTAAGGCTTCCCGATACAGAG | 1116 | 1150 | Negative | Yes | |
| AGGCTTCCCGATACAGAGCTGAG | 1117 | 1155 | Negative | Yes | |
| GGCTTCCCGATACAGAGCTGAGG | 1118 | 1156 | Negative | Yes | |
| TTCCCGATACAGAGCTGAGGCGG | 1119 | 1159 | Negative | Yes | |
| TACAGAGCTGAGGCGGTATCTAG | 1120 | 1166 | Negative | Yes | |
| AGAGCTGAGGCGGTATCTAGAAG | 1121 | 1169 | Negative | Yes | |
| ATCTAGAAGATCTCGTACTGAAG | 1122 | 1183 | Negative | Yes | |
| TCTAGAAGATCTCGTACTGAAGG | 1123 | 1184 | Negative | Yes | |
| GAAGATCTCGTACTGAAGGAAAG | 1124 | 1188 | Negative | Yes | |
| GATCTCGTACTGAAGGAAAGAAG | 1125 | 1191 | Negative | Yes | |
| TCGTACTGAAGGAAAGAAGTCAG | 1126 | 1195 | Negative | Yes | |
| TACTGAAGGAAAGAAGTCAGAAG | 1127 | 1198 | Negative | Yes | |
| ACTGAAGGAAAGAAGTCAGAAGG | 1128 | 1199 | Negative | Yes | |
| AGAAGTCAGAAGGCAAAAACGAG | 1129 | 1209 | Negative | Yes | |
| AAGTCAGAAGGCAAAAACGAGAG | 1130 | 1211 | Negative | Yes | |
| CAAAAACGAGAGTAACTCCACAG | 1131 | 1222 | Negative | Yes | Yes |
| AAACGAGAGTAACTCCACAGTAG | 1132 | 1225 | Negative | Yes | Yes |
| AGTAGCTCCAAATTCTTTATAAG | 1133 | 1243 | Negative | Yes | Yes |
| GTAGCTCCAAATTCTTTATAAGG | 1134 | 1244 | Negative | Yes | Yes |
| TAGCTCCAAATTCTTTATAAGGG | 1135 | 1245 | Negative | Yes | Yes |
| GGGTCGATGTCCATGCCCCAAAG | 1136 | 1265 | Negative | Yes | Yes |

TABLE 7-continued

SpCas9 sgRNAs

| 20 nt guide + 3 nt PAM | SEQ ID NO: | nt Start | Sense | Core? | Close to G17? |
|---|---|---|---|---|---|
| TCCATGCCCCAAAGCCACCCAAG | 1137 | 1274 | Negative | Yes | Yes |
| CCATGCCCCAAAGCCACCCAAGG | 1138 | 1275 | Negative | Yes | Yes |
| CCCCAAAGCCACCCAAGGCACAG | 1139 | 1280 | Negative | Yes | Yes |
| AAGCCACCCAAGGCACAGCTTGG | 1140 | 1285 | Negative | Yes | Yes |
| GCCACCCAAGGCACAGCTTGGAG | 1141 | 1287 | Negative | Yes | Yes |
| CCACCCAAGGCACAGCTTGGAGG | 1142 | 1288 | Negative | Yes | Yes |
| GCACAGCTTGGAGGCTTGAACAG | 1143 | 1297 | Negative | Yes | Yes |
| CAGCTTGGAGGCTTGAACAGTAG | 1144 | 1300 | Negative | Yes | Yes |
| AGCTTGGAGGCTTGAACAGTAGG | 1145 | 1301 | Negative | Yes | Yes |
| TTGAACAGTAGGACATGAACAAG | 1146 | 1312 | Negative | Yes | Yes |
| GAACAGTAGGACATGAACAAGAG | 1147 | 1314 | Negative | Yes | |
| GGACATGAACAAGAGATGATTAG | 1148 | 1322 | Negative | Yes | |
| GACATGAACAAGAGATGATTAGG | 1149 | 1323 | Negative | Yes | |
| ATGAACAAGAGATGATTAGGCAG | 1150 | 1326 | Negative | Yes | |
| GAACAAGAGATGATTAGGCAGAG | 1151 | 1328 | Negative | Yes | |
| AACAAGAGATGATTAGGCAGAGG | 1152 | 1329 | Negative | Yes | |
| ATGATTAGGCAGAGGTGAAAAAG | 1153 | 1337 | Negative | Yes | |
| GCAGAGGTGAAAAAGTTGCATGG | 1154 | 1345 | Negative | | |
| GTGAAAAAGTTGCATGGTGCTGG | 1155 | 1351 | Negative | | |
| AGTTGCATGGTGCTGGTGCGCAG | 1156 | 1358 | Negative | | |
| CGCAGACCAATTTATGCCTACAG | 1157 | 1376 | Negative | | |
| AATTTATGCCTACAGCCTCCTAG | 1158 | 1384 | Negative | | |
| GCCTACAGCCTCCTAGTACAAAG | 1159 | 1391 | Negative | | |
| TCTCCTCCCCAACTCCTCCCAG | 1160 | 1427 | Negative | | |
| CCTCCCAGTCTTTAAACAAACAG | 1161 | 1442 | Negative | | |
| CTTTAAACAAACAGTCTTTGAAG | 1162 | 1451 | Negative | | |
| CAGTCTTTGAAGTATGCCTCAAG | 1163 | 1462 | Negative | | |
| AGTCTTTGAAGTATGCCTCAAGG | 1164 | 1463 | Negative | | |
| TTTGAAGTATGCCTCAAGGTCGG | 1165 | 1467 | Negative | | |
| AAGGTCGGTCGTTGACATTGCAG | 1166 | 1482 | Negative | | |
| GGTCGGTCGTTGACATTGCAGAG | 1167 | 1484 | Negative | | |
| TCGGTCGTTGACATTGCAGAGAG | 1168 | 1486 | Negative | | |
| GTTGACATTGCAGAGAGTCCAAG | 1169 | 1492 | Negative | | |
| TGACATTGCAGAGAGTCCAAGAG | 1170 | 1494 | Negative | | |
| GTCCAAGAGTCCTCTTATGTAAG | 1171 | 1508 | Negative | | |
| AGTCCTCTTATGTAAGACCTTGG | 1172 | 1515 | Negative | | |
| GTCCTCTTATGTAAGACCTTGGG | 1173 | 1516 | Negative | | |
| GTAAGACCTTGGGCAACATTCGG | 1174 | 1526 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| AGACCTTGGGCAACATTCGGTGG | 1175 | 1529 | Negative | | |
| GACCTTGGGCAACATTCGGTGGG | 1176 | 1530 | Negative | | |
| CAACATTCGGTGGGCGTTCACGG | 1177 | 1539 | Negative | | |
| CATTCGGTGGGCGTTCACGGTGG | 1178 | 1542 | Negative | | |
| GGTGGTCTCCATGCGACGTGCAG | 1179 | 1560 | Negative | | |
| TGGTCTCCATGCGACGTGCAGAG | 1180 | 1562 | Negative | | |
| GGTCTCCATGCGACGTGCAGAGG | 1181 | 1563 | Negative | | |
| CCATGCGACGTGCAGAGGTGAAG | 1182 | 1568 | Negative | | |
| CGACGTGCAGAGGTGAAGCGAAG | 1183 | 1573 | Negative | | |
| GAGGTGAAGCGAAGTGCACACGG | 1184 | 1582 | Negative | | |
| GAAGCGAAGTGCACACGGTCCGG | 1185 | 1587 | Negative | | |
| GCGAAGTGCACACGGTCCGGCAG | 1186 | 1590 | Negative | | |
| GTGCACACGGTCCGGCAGATGAG | 1187 | 1595 | Negative | | |
| CACACGGTCCGGCAGATGAGAAG | 1188 | 1598 | Negative | | |
| ACACGGTCCGGCAGATGAGAAGG | 1189 | 1599 | Negative | | |
| GTCCGGCAGATGAGAAGGCACAG | 1190 | 1604 | Negative | | |
| GGCAGATGAGAAGGCACAGACGG | 1191 | 1608 | Negative | | |
| GCAGATGAGAAGGCACAGACGGG | 1192 | 1609 | Negative | | |
| CAGATGAGAAGGCACAGACGGGG | 1193 | 1610 | Negative | | |
| GATGAGAAGGCACAGACGGGGAG | 1194 | 1612 | Negative | | |
| ACAGACGGGGAGTCCGCGTAAAG | 1195 | 1623 | Negative | | |
| AGACGGGGAGTCCGCGTAAAGAG | 1196 | 1625 | Negative | | |
| ACGGGGAGTCCGCGTAAAGAGAG | 1197 | 1627 | Negative | | |
| CGGGGAGTCCGCGTAAAGAGAGG | 1198 | 1628 | Negative | | |
| GTAAAGAGAGGTGCGCCCCGTGG | 1199 | 1640 | Negative | | |
| AGAGAGGTGCGCCCCGTGGTCGG | 1200 | 1644 | Negative | | |
| AGGTGCGCCCCGTGGTCGGTCGG | 1201 | 1648 | Negative | | |
| CGCCCCGTGGTCGGTCGGAACGG | 1202 | 1653 | Negative | | |
| CCCGTGGTCGGTCGGAACGGCAG | 1203 | 1656 | Negative | | |
| TGGTCGGTCGGAACGGCAGACGG | 1204 | 1660 | Negative | | |
| GTCGGTCGGAACGGCAGACGGAG | 1205 | 1662 | Negative | | |
| GGTCGGAACGGCAGACGGAGAAG | 1206 | 1665 | Negative | | |
| GTCGGAACGGCAGACGGAGAAGG | 1207 | 1666 | Negative | | |
| TCGGAACGGCAGACGGAGAAGGG | 1208 | 1667 | Negative | | |
| CGGAACGGCAGACGGAGAAGGGG | 1209 | 1668 | Negative | | |
| CGGCAGACGGAGAAGGGGACGAG | 1210 | 1673 | Negative | | |
| GCAGACGGAGAAGGGGACGAGAG | 1211 | 1675 | Negative | | |
| AGACGGAGAAGGGGACGAGAGAG | 1212 | 1677 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| GAAGGGACGAGAGAGTCCCAAG | 1213 | 1684 | Negative | | |
| AGAGAGTCCCAAGCGACCCCGAG | 1214 | 1694 | Negative | | |
| GAGTCCCAAGCGACCCCGAGAAG | 1215 | 1697 | Negative | | |
| AGTCCCAAGCGACCCCGAGAAGG | 1216 | 1698 | Negative | | |
| GTCCCAAGCGACCCCGAGAAGGG | 1217 | 1699 | Negative | | |
| ACCCCGAGAAGGGTCGTCCGCAG | 1218 | 1709 | Negative | | |
| CCCCGAGAAGGGTCGTCCGCAGG | 1219 | 1710 | Negative | | |
| GAAGGGTCGTCCGCAGGATTCAG | 1220 | 1716 | Negative | | |
| TCCGCAGGATTCAGCGCCGACGG | 1221 | 1725 | Negative | | |
| CCGCAGGATTCAGCGCCGACGGG | 1222 | 1726 | Negative | | |
| GCGCCGACGGGACGTAAACAAAG | 1223 | 1738 | Negative | | |
| CGCCGACGGGACGTAAACAAAGG | 1224 | 1739 | Negative | | |
| TAAACAAAGGACGTCCCGCGCAG | 1225 | 1752 | Negative | | |
| AAACAAAGGACGTCCCGCGCAGG | 1226 | 1753 | Negative | | |
| AGGACGTCCCGCGCAGGATCCAG | 1227 | 1759 | Negative | | |
| CGTCCCGCGCAGGATCCAGTTGG | 1228 | 1763 | Negative | | |
| CCCGCGCAGGATCCAGTTGGCAG | 1229 | 1766 | Negative | | |
| GCAGGATCCAGTTGGCAGCACAG | 1230 | 1771 | Negative | | |
| ATCCAGTTGGCAGCACAGCCTAG | 1231 | 1776 | Negative | | |
| CAGTTGGCAGCACAGCCTAGCAG | 1232 | 1779 | Negative | | |
| GCAGCACAGCCTAGCAGCCATGG | 1233 | 1785 | Negative | | |
| ATGGATACGATGTATATTTGCGG | 1234 | 1804 | Negative | | |
| TGGATACGATGTATATTTGCGGG | 1235 | 1805 | Negative | | |
| GATACGATGTATATTTGCGGGAG | 1236 | 1807 | Negative | | |
| TACGATGTATATTTGCGGGAGAG | 1237 | 1809 | Negative | | |
| ACGATGTATATTTGCGGGAGAGG | 1238 | 1810 | Negative | | |
| ATATTTGCGGGAGAGGACAACAG | 1239 | 1817 | Negative | | |
| ATTTGCGGGAGAGGACAACAGAG | 1240 | 1819 | Negative | | |
| GGAGAGGACAACAGAGTTATCAG | 1241 | 1826 | Negative | | |
| AGTCCCGATAATGTTTGCTCCAG | 1242 | 1847 | Negative | | |
| GTTTGCTCCAGACCTGCTGCGAG | 1243 | 1859 | Negative | | |
| AGACCTGCTGCGAGCAAAACAAG | 1244 | 1868 | Negative | | |
| CCTGCTGCGAGCAAAACAAGCGG | 1245 | 1871 | Negative | | |
| CTGCGAGCAAAACAAGCGGCTAG | 1246 | 1875 | Negative | | |
| TGCGAGCAAAACAAGCGGCTAGG | 1247 | 1876 | Negative | | |
| CGAGCAAAACAAGCGGCTAGGAG | 1248 | 1878 | Negative | | |
| ACAAGCGGCTAGGAGTTCCGCAG | 1249 | 1886 | Negative | | |
| CGGCTAGGAGTTCCGCAGTATGG | 1250 | 1891 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| AGGAGTTCCGCAGTATGGATCGG | 1251 | 1896 | Negative | | |
| AGTTCCGCAGTATGGATCGGCAG | 1252 | 1899 | Negative | | |
| TTCCGCAGTATGGATCGGCAGAG | 1253 | 1901 | Negative | | |
| TCCGCAGTATGGATCGGCAGAGG | 1254 | 1902 | Negative | | |
| CGCAGTATGGATCGGCAGAGGAG | 1255 | 1904 | Negative | | |
| GGATCGGCAGAGGAGCCGAAAAG | 1256 | 1912 | Negative | | |
| GATCGGCAGAGGAGCCGAAAAGG | 1257 | 1913 | Negative | | |
| AGGTTCCACGCACGCGCTGATGG | 1258 | 1933 | Negative | | |
| CGCGCTGATGGCCCATGACCAAG | 1259 | 1945 | Negative | | |
| GATGGCCCATGACCAAGCCCCAG | 1260 | 1951 | Negative | | |
| GCCCATGACCAAGCCCCAGCCAG | 1261 | 1955 | Negative | | |
| CATGACCAAGCCCCAGCCAGTGG | 1262 | 1958 | Negative | | |
| ATGACCAAGCCCCAGCCAGTGGG | 1263 | 1959 | Negative | | |
| TGACCAAGCCCCAGCCAGTGGGG | 1264 | 1960 | Negative | | |
| GACCAAGCCCCAGCCAGTGGGGG | 1265 | 1961 | Negative | | |
| CCAGCCAGTGGGGTTGCGTCAG | 1266 | 1970 | Negative | | |
| GGGTTGCGTCAGCAAACACTTGG | 1267 | 1981 | Negative | | |
| GCGTCAGCAAACACTTGGCACAG | 1268 | 1986 | Negative | | |
| GCAAACACTTGGCACAGACCTGG | 1269 | 1992 | Negative | | |
| GGCACAGACCTGGCCGTTGCCGG | 1270 | 2002 | Negative | | |
| GCACAGACCTGGCCGTTGCCGGG | 1271 | 2003 | Negative | | |
| ACCTGGCCGTTGCCGGGCAACGG | 1272 | 2009 | Negative | | |
| CCTGGCCGTTGCCGGGCAACGGG | 1273 | 2010 | Negative | | |
| CTGGCCGTTGCCGGGCAACGGGG | 1274 | 2011 | Negative | | |
| CGTTGCCGGGCAACGGGGTAAAG | 1275 | 2016 | Negative | | |
| GTTGCCGGGCAACGGGGTAAAGG | 1276 | 2017 | Negative | | |
| CGGGCAACGGGGTAAAGGTTCAG | 1277 | 2022 | Negative | | |
| GGGCAACGGGGTAAAGGTTCAGG | 1278 | 2023 | Negative | | |
| AGGTTCAGGTATTGTTTACACAG | 1279 | 2037 | Negative | | |
| TCAGGTATTGTTTACACAGAAAG | 1280 | 2041 | Negative | | |
| CAGGTATTGTTTACACAGAAAGG | 1281 | 2042 | Negative | | |
| TTTACACAGAAAGGCCTTGTAAG | 1282 | 2051 | Negative | | |
| CACAGAAAGGCCTTGTAAGTTGG | 1283 | 2055 | Negative | | |
| GAAAGGCCTTGTAAGTTGGCGAG | 1284 | 2059 | Negative | | |
| GGCCTTGTAAGTTGGCGAGAAAG | 1285 | 2063 | Negative | | |
| GTAAGTTGGCGAGAAAGTGAAAG | 1286 | 2069 | Negative | | |
| CGAGAAAGTGAAAGCCTGCTTAG | 1287 | 2078 | Negative | | |
| TAGATTGAATACATGCATACAAG | 1288 | 2098 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| AGATTGAATACATGCATACAAGG | 1289 | 2099 | Negative | | |
| GATTGAATACATGCATACAAGGG | 1290 | 2100 | Negative | | |
| TGCATACAAGGGCATTAACGCAG | 1291 | 2111 | Negative | | |
| GCATACAAGGGCATTAACGCAGG | 1292 | 2112 | Negative | | |
| GGATAACCACATTGTGTAAATGG | 1293 | 2133 | Negative | | |
| GATAACCACATTGTGTAAATGGG | 1294 | 2134 | Negative | | |
| ATAACCACATTGTGTAAATGGGG | 1295 | 2135 | Negative | | |
| ACCACATTGTGTAAATGGGCAG | 1296 | 2138 | Negative | | |
| AATGGGCAGCAAAACCCAAAAG | 1297 | 2151 | Negative | | |
| TTGACATACTTTCCAATCAATAG | 1298 | 2186 | Negative | | |
| TGACATACTTTCCAATCAATAGG | 1299 | 2187 | Negative | | |
| CCAATCAATAGGCCTGTTAATAG | 1300 | 2198 | Negative | | |
| CAATCAATAGGCCTGTTAATAGG | 1301 | 2199 | Negative | | |
| TCAATAGGCCTGTTAATAGGAAG | 1302 | 2202 | Negative | | |
| TTTTGTATGATGTGTTCTTGTGG | 1303 | 2247 | Negative | | |
| GTATGATGTGTTCTTGTGGCAAG | 1304 | 2251 | Negative | | |
| TATGATGTGTTCTTGTGGCAAGG | 1305 | 2252 | Negative | | |
| ATGACATAACCCATAAAATTCAG | 1306 | 2289 | Negative | | |
| GACATAACCCATAAAATTCAGAG | 1307 | 2291 | Negative | | |
| CATAACCCATAAAATTCAGAGAG | 1308 | 2293 | Negative | | |
| ACCCCATCTCTTTGTTTTGTTAG | 1309 | 2318 | Negative | | |
| CCCCATCTCTTTGTTTTGTTAGG | 1310 | 2319 | Negative | | |
| CCCATCTCTTTGTTTTGTTAGGG | 1311 | 2320 | Negative | | |
| AGGGTTTAAATGTATACCCAAAG | 1312 | 2339 | Negative | | |
| AAATGTATACCCAAAGACAAAAG | 1313 | 2346 | Negative | | |
| ACCCAAAGACAAAAGAAAATTGG | 1314 | 2354 | Negative | | |
| AGACAAAAGAAAATTGGTAACAG | 1315 | 2360 | Negative | | |
| CAAAAGAAAATTGGTAACAGCGG | 1316 | 2363 | Negative | | |
| AAATTGGTAACAGCGGTAAAAAG | 1317 | 2370 | Negative | | |
| AATTGGTAACAGCGGTAAAAAGG | 1318 | 2371 | Negative | | |
| ATTGGTAACAGCGGTAAAAAGGG | 1319 | 2372 | Negative | | |
| ACAGCGGTAAAAGGGACTCAAG | 1320 | 2379 | Negative | | |
| AAGGGACTCAAGATGCTGTACAG | 1321 | 2390 | Negative | | |
| CTCAAGATGCTGTACAGACTTGG | 1322 | 2396 | Negative | | |
| CACATCATCCATATAACTGAAAG | 1323 | 2429 | Negative | | |
| CCATATAACTGAAAGCCAAACAG | 1324 | 2437 | Negative | | |
| TATAACTGAAAGCCAAACAGTGG | 1325 | 2440 | Negative | | |
| ATAACTGAAAGCCAAACAGTGGG | 1326 | 2441 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| TAACTGAAAGCCAAACAGTGGGG | 1327 | 2442 | Negative | | |
| AACTGAAAGCCAAACAGTGGGGG | 1328 | 2443 | Negative | | |
| GAAAGCCAAACAGTGGGGAAAG | 1329 | 2447 | Negative | | |
| CCTACGAACCACTGAACAAATGG | 1330 | 2471 | Negative | | |
| AACCACTGAACAAATGGCACTAG | 1331 | 2477 | Negative | | |
| ACAAATGGCACTAGTAAACTGAG | 1332 | 2486 | Negative | | |
| ATGGCACTAGTAAACTGAGCCAG | 1333 | 2490 | Negative | | |
| TGGCACTAGTAAACTGAGCCAGG | 1334 | 2491 | Negative | | |
| GCACTAGTAAACTGAGCCAGGAG | 1335 | 2493 | Negative | | |
| GTAAACTGAGCCAGGAGAAACGG | 1336 | 2499 | Negative | | |
| TAAACTGAGCCAGGAGAAACGGG | 1337 | 2500 | Negative | | |
| TGAGCCAGGAGAAACGGGCTGAG | 1338 | 2505 | Negative | | |
| GAGCCAGGAGAAACGGGCTGAGG | 1339 | 2506 | Negative | | |
| CGGGCTGAGGCCCACTCCCATAG | 1340 | 2519 | Negative | | |
| GGGCTGAGGCCCACTCCCATAGG | 1341 | 2520 | Negative | | |
| CTCCCATAGGAATTTTCCGAAAG | 1342 | 2533 | Negative | | |
| ATAGGAATTTTCCGAAAGCCCAG | 1343 | 2538 | Negative | | |
| TAGGAATTTTCCGAAAGCCCAGG | 1344 | 2539 | Negative | | |
| TTTCCGAAAGCCCAGGATGATGG | 1345 | 2546 | Negative | | |
| TTCCGAAAGCCCAGGATGATGGG | 1346 | 2547 | Negative | | |
| GAAAGCCCAGGATGATGGGATGG | 1347 | 2551 | Negative | | |
| AAAGCCCAGGATGATGGGATGGG | 1348 | 2552 | Negative | | |
| AGGATGATGGGATGGGAATACAG | 1349 | 2559 | Negative | | |
| GGATGATGGGATGGGAATACAGG | 1350 | 2560 | Negative | | |
| ACAGGTGCAATTTCCGTCCGAAG | 1351 | 2578 | Negative | | |
| CAGGTGCAATTTCCGTCCGAAGG | 1352 | 2579 | Negative | | |
| GCAATTTCCGTCCGAAGGTTTGG | 1353 | 2584 | Negative | | |
| TTCCGTCCGAAGGTTTGGTACAG | 1354 | 2589 | Negative | | |
| CCGAAGGTTTGGTACAGCAACAG | 1355 | 2595 | Negative | | |
| CGAAGGTTTGGTACAGCAACAGG | 1356 | 2596 | Negative | | |
| AAGGTTTGGTACAGCAACAGGAG | 1357 | 2598 | Negative | | |
| AGGTTTGGTACAGCAACAGGAGG | 1358 | 2599 | Negative | | |
| GGTTTGGTACAGCAACAGGAGGG | 1359 | 2600 | Negative | | |
| ACAGCAACAGGAGGGATACATAG | 1360 | 2608 | Negative | | |
| AGCAACAGGAGGGATACATAGAG | 1361 | 2610 | Negative | | |
| GCAACAGGAGGGATACATAGAGG | 1362 | 2611 | Negative | | |
| GGGATACATAGAGGTTCCTTGAG | 1363 | 2620 | Negative | | |
| ATACATAGAGGTTCCTTGAGCAG | 1364 | 2623 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| CATAGAGGTTCCTTGAGCAGTAG | 1365 | 2626 | Negative | | |
| TTCCTTGAGCAGTAGTCATGCAG | 1366 | 2634 | Negative | | |
| TCCTTGAGCAGTAGTCATGCAGG | 1367 | 2635 | Negative | | |
| GAGCAGTAGTCATGCAGGTTCGG | 1368 | 2640 | Negative | | |
| GTAGTCATGCAGGTTCGGCATGG | 1369 | 2645 | Negative | | |
| GGTTCGGCATGGTCCCGTGCTGG | 1370 | 2656 | Negative | | |
| TCGGCATGGTCCCGTGCTGGTGG | 1371 | 2659 | Negative | | |
| ATGGTCCCGTGCTGGTGGTTGAG | 1372 | 2664 | Negative | | |
| TGGTCCCGTGCTGGTGGTTGAGG | 1373 | 2665 | Negative | | |
| GTGCTGGTGGTTGAGGATCCTGG | 1374 | 2672 | Negative | | |
| GTGGTTGAGGATCCTGGAATTAG | 1375 | 2678 | Negative | | |
| GGTTGAGGATCCTGGAATTAGAG | 1376 | 2680 | Negative | | |
| GTTGAGGATCCTGGAATTAGAGG | 1377 | 2681 | Negative | | |
| TCCTGGAATTAGAGGACAAACGG | 1378 | 2689 | Negative | | |
| CCTGGAATTAGAGGACAAACGGG | 1379 | 2690 | Negative | | |
| AAACGGGCAACATACCTTGATAG | 1380 | 2706 | Negative | | |
| GGCAACATACCTTGATAGTCCAG | 1381 | 2711 | Negative | | |
| AACATACCTTGATAGTCCAGAAG | 1382 | 2714 | Negative | | |
| GATAGTCCAGAAGAACCAACAAG | 1383 | 2724 | Negative | | |
| AGTCCAGAAGAACCAACAAGAAG | 1384 | 2727 | Negative | | |
| AGAAGAACCAACAAGAAGATGAG | 1385 | 2732 | Negative | | |
| GAAGAACCAACAAGAAGATGAGG | 1386 | 2733 | Negative | | |
| ACCAACAAGAAGATGAGGCATAG | 1387 | 2738 | Negative | | |
| AACAAGAAGATGAGGCATAGCAG | 1388 | 2741 | Negative | | |
| AAGAAGATGAGGCATAGCAGCAG | 1389 | 2744 | Negative | | |
| AGAAGATGAGGCATAGCAGCAGG | 1390 | 2745 | Negative | | |
| TGAGGCATAGCAGCAGGATGAAG | 1391 | 2751 | Negative | | |
| AGGCATAGCAGCAGGATGAAGAG | 1392 | 2753 | Negative | | |
| GGCATAGCAGCAGGATGAAGAGG | 1393 | 2754 | Negative | | |
| ATAGCAGCAGGATGAAGAGGAAG | 1394 | 2757 | Negative | | |
| AGGAAGATGATAAAACGCCGCAG | 1395 | 2774 | Negative | | |
| TAAAACGCCGCAGACACATCCAG | 1396 | 2784 | Negative | | |
| CAGACACATCCAGCGATAACCAG | 1397 | 2794 | Negative | | |
| AGACACATCCAGCGATAACCAGG | 1398 | 2795 | Negative | | |
| CATCCAGCGATAACCAGGACAAG | 1399 | 2800 | Negative | | |
| CAGCGATAACCAGGACAAGTTGG | 1400 | 2804 | Negative | | |
| GCGATAACCAGGACAAGTTGGAG | 1401 | 2806 | Negative | | |
| CGATAACCAGGACAAGTTGGAGG | 1402 | 2807 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| AACCAGGACAAGTTGGAGGACAG | 1403 | 2811 | Negative | | |
| ACCAGGACAAGTTGGAGGACAGG | 1404 | 2812 | Negative | | |
| CAGGACAAGTTGGAGGACAGGAG | 1405 | 2814 | Negative | | |
| AGGACAAGTTGGAGGACAGGAGG | 1406 | 2815 | Negative | | |
| CAAGTTGGAGGACAGGAGGTTGG | 1407 | 2819 | Negative | | |
| TTGGAGGACAGGAGGTTGGTGAG | 1408 | 2823 | Negative | | |
| ACAGGAGGTTGGTGAGTGATTGG | 1409 | 2830 | Negative | | |
| AGGAGGTTGGTGAGTGATTGGAG | 1410 | 2832 | Negative | | |
| GGAGGTTGGTGAGTGATTGGAGG | 1411 | 2833 | Negative | | |
| GTTGGTGAGTGATTGGAGGTTGG | 1412 | 2837 | Negative | | |
| TTGGTGAGTGATTGGAGGTTGGG | 1413 | 2838 | Negative | | |
| TGGTGAGTGATTGGAGGTTGGGG | 1414 | 2839 | Negative | | |
| AGGTTGGGGACTGCGAATTTTGG | 1415 | 2853 | Negative | | |
| GGGGACTGCGAATTTTGGCCAAG | 1416 | 2858 | Negative | | |
| CGAATTTTGGCCAAGACACACGG | 1417 | 2866 | Negative | | |
| ATTTTGGCCAAGACACACGGTAG | 1418 | 2869 | Negative | | |
| AGACACGGTAGTTCCCCCTAG | 1419 | 2879 | Negative | | |
| GTAGTTCCCCCTAGAAAATTGAG | 1420 | 2888 | Negative | | |
| AGTTCCCCCTAGAAAATTGAGAG | 1421 | 2890 | Negative | | |
| TCCCCCTAGAAAATTGAGAGAAG | 1422 | 2893 | Negative | | |
| AATTGAGAGAAGTCCACCACGAG | 1423 | 2904 | Negative | | |
| AGAGAAGTCCACCACGAGTCTAG | 1424 | 2909 | Negative | | |
| CACCACGAGTCTAGACTCTGCGG | 1425 | 2918 | Negative | | |
| TCTAGACTCTGCGGTATTGTGAG | 1426 | 2927 | Negative | | |
| CTAGACTCTGCGGTATTGTGAGG | 1427 | 2928 | Negative | | |
| TTGTGAGGATTCTTGTCAACAAG | 1428 | 2943 | Negative | | |
| AAAAACCCCGCCTGTAACACGAG | 1429 | 2966 | Negative | | |
| AACCCCGCCTGTAACACGAGAAG | 1430 | 2969 | Negative | | |
| ACCCCGCCTGTAACACGAGAAGG | 1431 | 2970 | Negative | | |
| CCCCGCCTGTAACACGAGAAGGG | 1432 | 2971 | Negative | | |
| CCCGCCTGTAACACGAGAAGGGG | 1433 | 2972 | Negative | | |
| TGTAACACGAGAAGGGGTCCTAG | 1434 | 2978 | Negative | | |
| GTAACACGAGAAGGGGTCCTAGG | 1435 | 2979 | Negative | | |
| GATGTGATGTTCTCCATGTTCAG | 1436 | 3008 | Negative | | |
| GATGTTCTCCATGTTCAGCGCAG | 1437 | 3013 | Negative | | |
| ATGTTCTCCATGTTCAGCGCAGG | 1438 | 3014 | Negative | | |
| TGTTCTCCATGTTCAGCGCAGGG | 1439 | 3015 | Negative | | |
| GCGCAGGGTCCCCAATCCTCGAG | 1440 | 3030 | Negative | | |

TABLE 7-continued

SpCas9 sgRNAs

| 20 nt guide + 3 nt PAM | SEQ ID NO: | nt Start | Sense | Core? | Close to G17? |
|---|---|---|---|---|---|
| CAGGGTCCCCAATCCTCGAGAAG | 1441 | 3033 | Negative | | |
| TCCTCGAGAAGATTGACGATAAG | 1442 | 3045 | Negative | | |
| CCTCGAGAAGATTGACGATAAGG | 1443 | 3046 | Negative | | |
| CTCGAGAAGATTGACGATAAGGG | 1444 | 3047 | Negative | | |
| CGAGAAGATTGACGATAAGGGAG | 1445 | 3049 | Negative | | |
| AGAAGATTGACGATAAGGGAGAG | 1446 | 3051 | Negative | | |
| GAAGATTGACGATAAGGGAGAGG | 1447 | 3052 | Negative | | |
| GATTGACGATAAGGGAGAGGCAG | 1448 | 3055 | Negative | | |
| TGACGATAAGGGAGAGGCAGTAG | 1449 | 3058 | Negative | | |
| GATAAGGGAGAGGCAGTAGTCGG | 1450 | 3062 | Negative | | |
| GGGAGAGGCAGTAGTCGGAACAG | 1451 | 3067 | Negative | | |
| GGAGAGGCAGTAGTCGGAACAGG | 1452 | 3068 | Negative | | |
| GAGAGGCAGTAGTCGGAACAGGG | 1453 | 3069 | Negative | | |
| AGGGTTTACTGCTCCTGAACTGG | 1454 | 3088 | Negative | | |
| GGTTTACTGCTCCTGAACTGGAG | 1455 | 3090 | Negative | | |
| TGCTCCTGAACTGGAGCCACCAG | 1456 | 3097 | Negative | | |
| TCCTGAACTGGAGCCACCAGCAG | 1457 | 3100 | Negative | | |
| CCTGAACTGGAGCCACCAGCAGG | 1458 | 3101 | Negative | | |
| CTGAACTGGAGCCACCAGCAGGG | 1459 | 3102 | Negative | | |
| GAGCCACCAGCAGGGAAATACAG | 1460 | 3110 | Negative | | |
| AGCCACCAGCAGGGAAATACAGG | 1461 | 3111 | Negative | | |
| GAAATACAGGCCTCTCACTCTGG | 1462 | 3124 | Negative | | |
| AAATACAGGCCTCTCACTCTGGG | 1463 | 3125 | Negative | | |
| CCTCTCACTCTGGGATCTTGCAG | 1464 | 3134 | Negative | | |
| TCTCACTCTGGGATCTTGCAGAG | 1465 | 3136 | Negative | | |
| CTCTGGGATCTTGCAGAGTTTGG | 1466 | 3141 | Negative | | |
| GATCTTGCAGAGTTTGGTGAAAG | 1467 | 3147 | Negative | | |
| ATCTTGCAGAGTTTGGTGAAAGG | 1468 | 3148 | Negative | | |
| CAGAGTTTGGTGAAAGGTTGTGG | 1469 | 3154 | Negative | | |

Preliminary next-gen sequencing was performed to identify the level of indel formation at top predicted off-target sites (using the Hsu 2013 algorithm), and Applicants' current data shows no indel formation at 3 separate off-target sites for each of 3 separate sgRNAs (g6, g17, g21) in the HepG2.2.15 model system.

Figure 73:
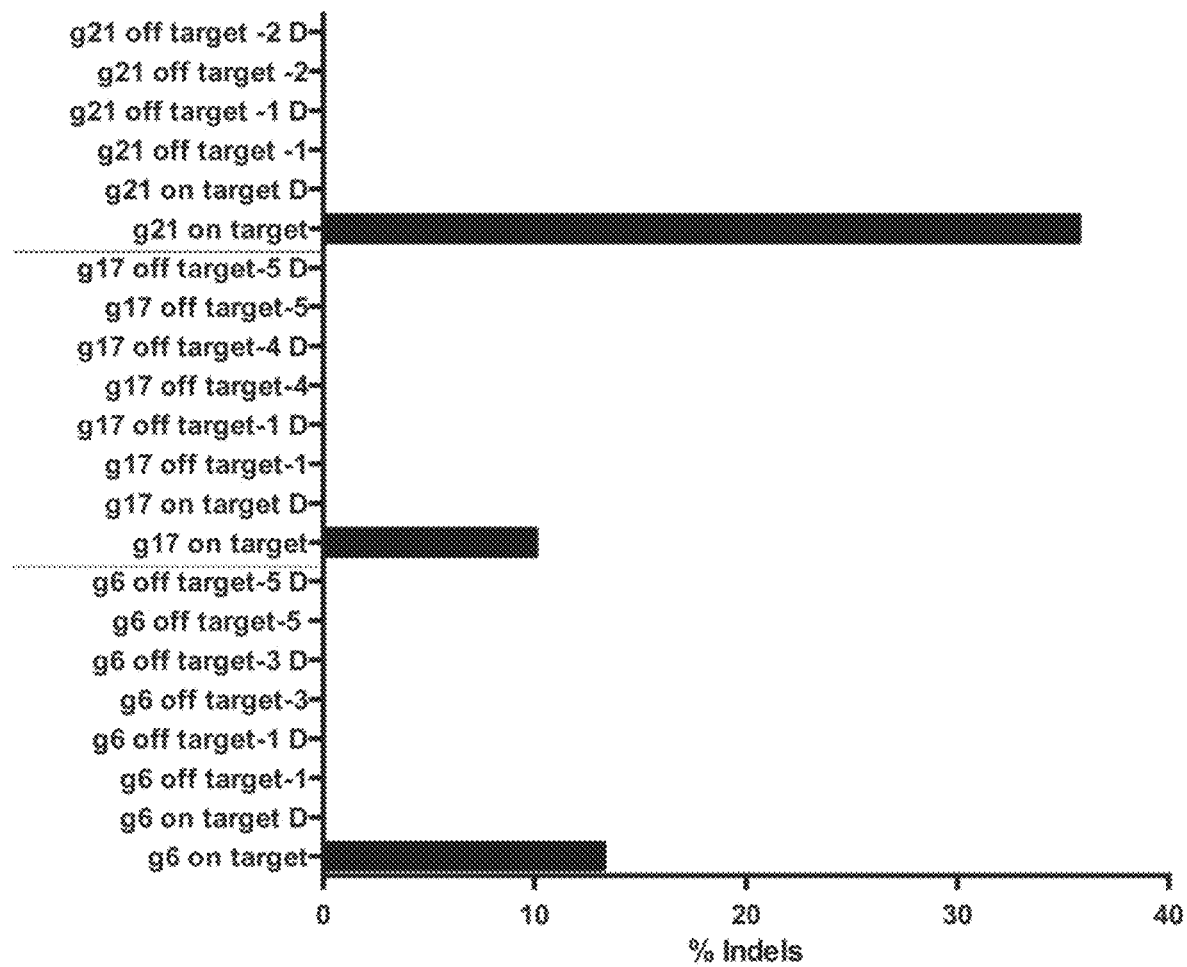
FIG. 73 depicts a plot where the columns labeled 'D' signify where Applicants used a nuclease-deficient Cas9 as an internal control. The 29 dpt corresponds to 29 days post transduction, where a single lentiviral vector encoding U6-sgRNA and EFS-hSpCas9-2A-Puro was transduced into HepG2.2.15 cells followed by selection with puromycin.

In the plot as depicted in FIG. 73, the columns labeled 'D' signify where Applicants used a nuclease-deficient Cas9 as an internal control. The 29 dpt corresponds to 29 days post transduction, where a single lentiviral vector encoding U6-sgRNA and EFS-hSpCas9-2A-Puro was transduced into HepG2.2.15 cells followed by selection with puromycin. The caveat is that the read depth was lower than ideal (~200-1000+ reads per target site), and that the on-target indels determined in this experiment are somewhat lower than what Applicants saw by Surveyor assay-however, it is promising that after stringent puromycin selection and constitutive expression of Cas9 and sgRNA for 29 days, still no indels are detected at possible off-target sites.

Additional anti-HBV CRISPR strategies: Previous studies have shown that CRISPR/Cas9 systems can be used for transcriptional activation when nuclease-deficient Cas9 is fused to activator domains. Specifically regarding HBV, it was recently shown that specific perturbations which upregulate APOBEC3A or APOBEC3B activity in HBV-infected hepatocytes can lead to HBV cccDNA clearance by specific C→U→T editing of the HBV genome leading to cccDNA degradation (Lucifora et al. Science 14 Mar. 2014:

Vol. 343 no. 6176 pp. 1221-1228). Since the CRISPR-based activation system can specifically upregulate targeted genes, it is possible to target APOBEC3A, APOBEC3B, and/or other antiviral interferon-stimulated genes (ISGs) using this system in order to target HBV cccDNA for degradation. While this is an indirect approach, the advantage here may be that the use of a nuclease-competent Cas9 is not required, potentially reducing the chance of deleterious off-target effects.

Examples

The following examples are given for the purpose of illustrating various embodiments of the invention and are not meant to limit the present invention in any fashion. The present examples, along with the methods described herein are presently representative of preferred embodiments, are exemplary, and are not intended as limitations on the scope of the invention. Changes therein and other uses which are encompassed within the spirit of the invention as defined by the scope of the claims will occur to those skilled in the art.

Example 1: CRISPR Complex Activity in the Nucleus of a Eukaryotic Cell

An example type II CRISPR system is the type II CRISPR locus from *Streptococcus pyogenes* SF370, which contains a cluster of four genes Cas9, Cas1, Cas2, and Csn1, as well as two non-coding RNA elements, tracrRNA and a characteristic array of repetitive sequences (direct repeats) interspaced by short stretches of non-repetitive sequences (spacers, about 30 bp each). In this system, targeted DNA double-strand break (DSB) is generated in four sequential steps (FIG. 2A). First, two non-coding RNAs, the pre-crRNA array and tracrRNA, are transcribed from the CRISPR locus. Second, tracrRNA hybridizes to the direct repeats of pre-crRNA, which is then processed into mature crRNAs containing individual spacer sequences. Third, the mature crRNA:tracrRNA complex directs Cas9 to the DNA target consisting of the protospacer and the corresponding PAM via heteroduplex formation between the spacer region of the crRNA and the protospacer DNA. Finally, Cas9 mediates cleavage of target DNA upstream of PAM to create a DSB within the protospacer (FIG. 2A). This example describes an example process for adapting this RNA-programmable nuclease system to direct CRISPR complex activity in the nuclei of eukaryotic cells.

Cell Culture and Transfection

Human embryonic kidney (HEK) cell line HEK 293FT (Life Technologies) was maintained in Dulbecco's modified Eagle's Medium (DMEM) supplemented with 10% fetal bovine serum (HyClone), 2 mM GlutaMAX (Life Technologies), 100 U/mL penicillin, and 100 μg/mL streptomycin at 37° C. with 5% C02 incubation. Mouse neuro2A (N2A) cell line (ATCC) was maintained with DMEM supplemented with 5% fetal bovine serum (HyClone), 2 mM GlutaMAX (Life Technologies), 100 U/mL penicillin, and 100 μg/mL streptomycin at 37° C. with 5% C02.

HEK 293FT or N2A cells were seeded into 24-well plates (Corning) one day prior to transfection at a density of 200,000 cells per well. Cells were transfected using Lipofectamine 2000 (Life Technologies) following the manufacturer's recommended protocol. For each well of a 24-well plate a total of 800 ng of plasmids were used.

Surveyor Assay and Sequencing Analysis for Genome Modification

HEK 293FT or N2A cells were transfected with plasmid DNA as described above. After transfection, the cells were incubated at 37° C. for 72 hours before genomic DNA extraction. Genomic DNA was extracted using the QuickExtract DNA extraction kit (Epicentre) following the manufacturer's protocol. Briefly, cells were resuspended in QuickExtract solution and incubated at 65° C. for 15 minutes and 98° C. for 10 minutes. Extracted genomic DNA was immediately processed or stored at −20° C.

Figure 7:
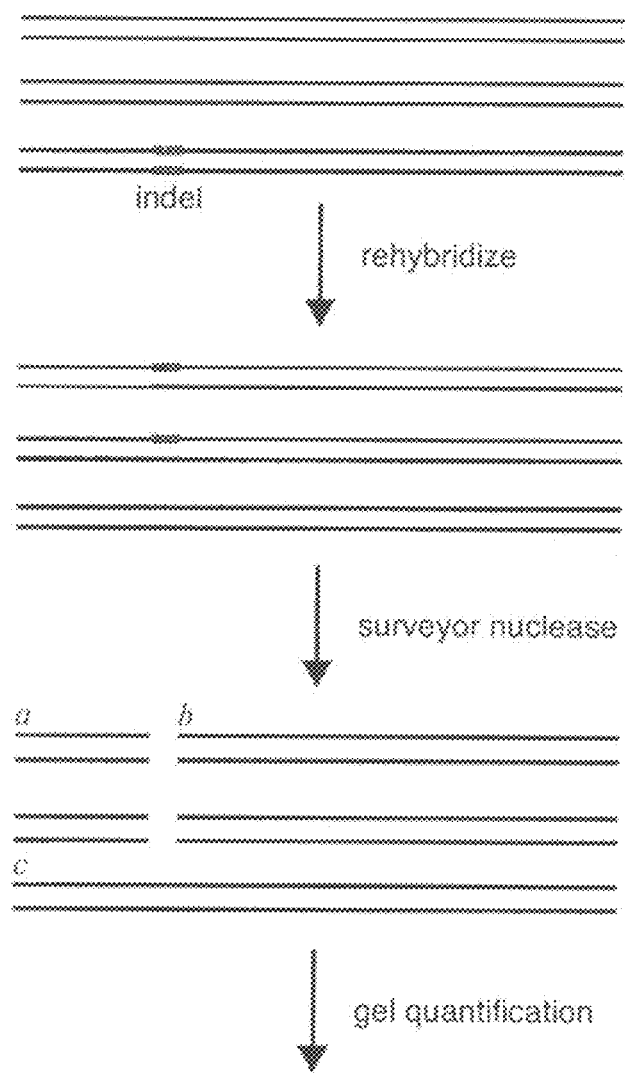
FIG. 7 shows a schematic of a surveyor nuclease assay for detection of double strand break-induced micro-insertions and -deletions.

The genomic region surrounding a CRISPR target site for each gene was PCR amplified, and products were purified using QiaQuick Spin Column (Qiagen) following manufacturer's protocol. A total of 400 ng of the purified PCR products were mixed with 2 μl 10× Taq polymerase PCR buffer (Enzymatics) and ultrapure water to a final volume of 20 μl, and subjected to a re-annealing process to enable heteroduplex formation: 95° C. for 10 min, 95° C. to 85° C. ramping at −2° C./s, 85° C. to 25° C. at −0.25° C./s, and 25° C. hold for 1 minute. After re-annealing, products were treated with Surveyor nuclease and Surveyor enhancer S (Transgenomics) following the manufacturer's recommended protocol, and analyzed on 4-20% Novex TBE poly-acrylamide gels (Life Technologies). Gels were stained with SYBR Gold DNA stain (Life Technologies) for 30 minutes and imaged with a Gel Doc gel imaging system (Bio-rad). Quantification was based on relative band intensities, as a measure of the fraction of cleaved DNA. FIG. 7 provides a schematic illustration of this Surveyor assay.

Restriction fragment length polymorphism assay for detection of homologous recombination.

HEK 293FT and N2A cells were transfected with plasmid DNA, and incubated at 37° C. for 72 hours before genomic DNA extraction as described above. The target genomic region was PCR amplified using primers outside the homology arms of the homologous recombination (HR) template. PCR products were separated on a 1% agarose gel and extracted with MinElute GelExtraction Kit (Qiagen). Purified products were digested with HindIII (Fermentas) and analyzed on a 6% Novex TBE poly-acrylamide gel (Life Technologies).

RNA Secondary Structure Prediction and Analysis

RNA secondary structure prediction was performed using the online webserver RNAfold developed at Institute for Theoretical Chemistry at the University of Vienna, using the centroid structure prediction algorithm (see e.g. A. R. Gruber et al., 2008, Cell 106(1): 23-24; and PA Carr and GM Church, 2009, Nature Biotechnology 27(12): 1151-62).

RNA Purification

HEK 293FT cells were maintained and transfected as stated above. Cells were harvested by trypsinization followed by washing in phosphate buffered saline (PBS). Total cell RNA was extracted with TRI reagent (Sigma) following manufacturer's protocol. Extracted total RNA was quantified using Naonodrop (Thermo Scientific) and normalized to same concentration.

Northern Blot Analysis of crRNA and tracrRNA Expression in Mammalian Cells

RNAs were mixed with equal volumes of 2× loading buffer (Ambion), heated to 95° C. for 5 min, chilled on ice for 1 min, and then loaded onto 8% denaturing polyacrylamide gels (SequaGel, National Diagnostics) after pre-running the gel for at least 30 minutes. The samples were electrophoresed for 1.5 hours at 40 W limit. Afterwards, the RNA was transferred to Hybond N+ membrane (GE Healthcare) at 300 mA in a semi-dry transfer apparatus (Bio-rad) at room temperature for 1.5 hours. The RNA was crosslinked to the membrane using autocrosslink button on Stratagene UV Crosslinker the Stratalinker (Stratagene). The membrane was pre-hybridized in ULTRAhyb-Oligo Hybridization Buffer (Ambion) for 30 min with rotation at 42° C., and probes were then added and hybridized overnight. Probes were ordered from IDT and labeled with [gamma-$^{32}$P] ATP (Perkin Elmer) with T4 polynucleotide kinase (New England Biolabs). The membrane was washed once with pre-warmed (42° C.) 2×SSC, 0.5% SDS for 1 min followed by two 30 minute washes at 42° C. The membrane was exposed to a phosphor screen for one hour or overnight at room temperature and then scanned with a phosphorimager (Typhoon).

Bacterial CRISPR System Construction and Evaluation

Figure 6A:
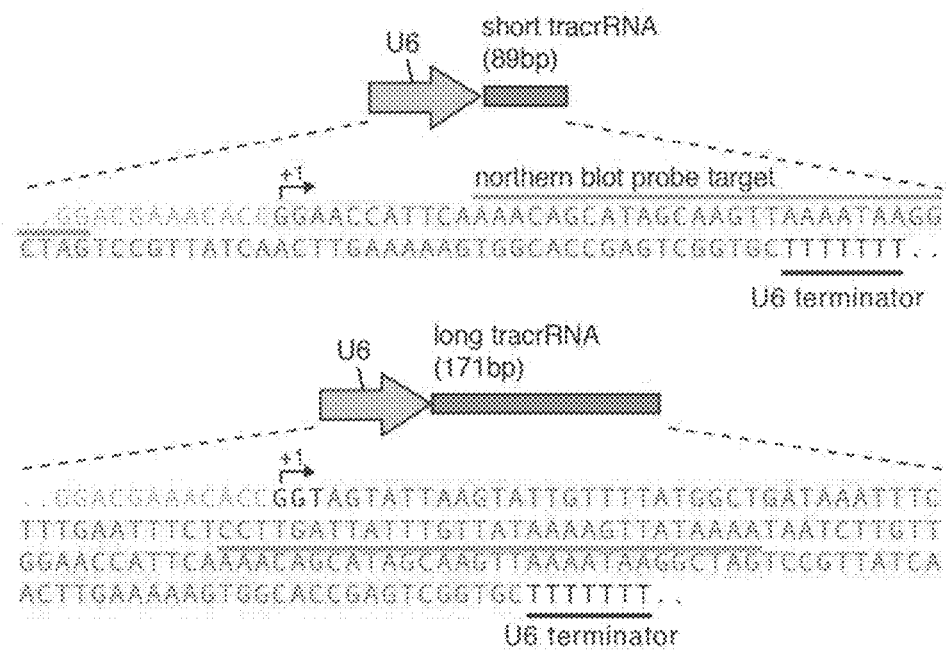
FIG. 6A-C shows a comparison of different tracrRNA transcripts for Cas9-mediated gene targeting.
Figure 6B:
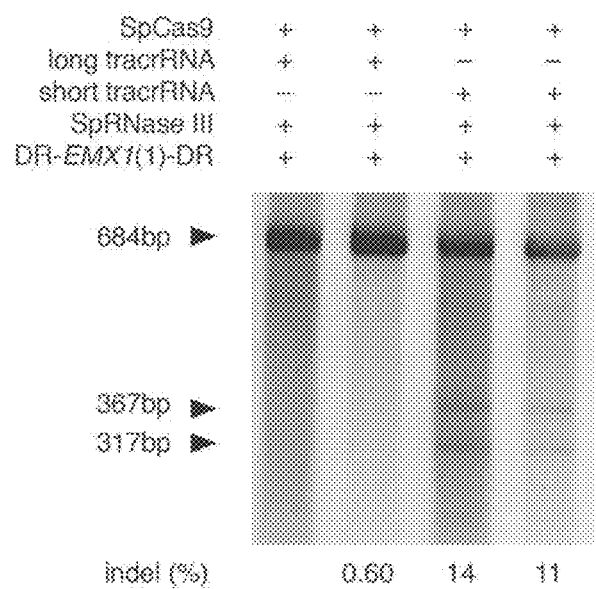
Figure 6C:
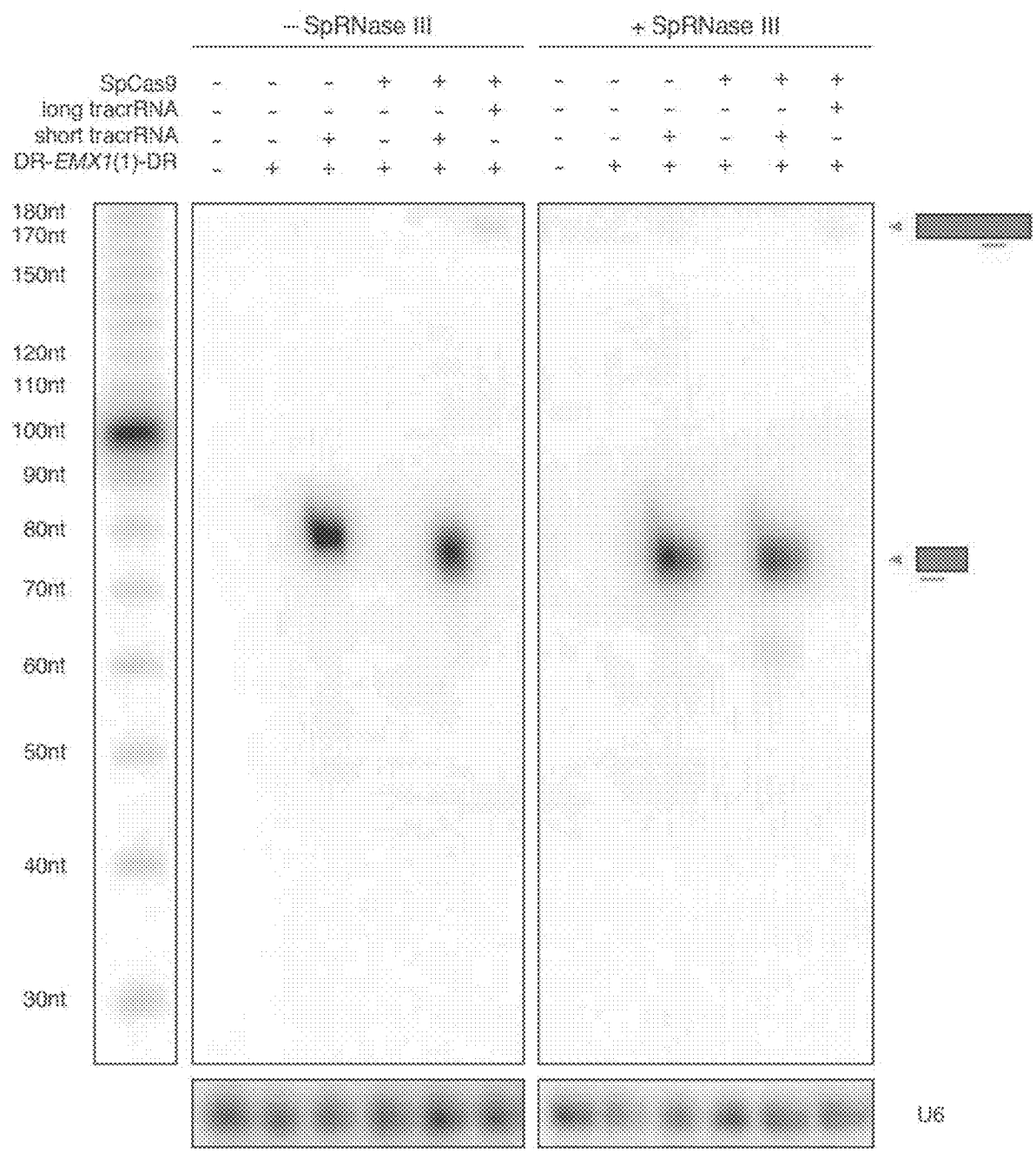

CRISPR locus elements, including tracrRNA, Cas9, and leader were PCR amplified from *Streptococcus pyogenes* SF370 genomic DNA with flanking homology arms for Gibson Assembly. Two BsaI type IIS sites were introduced in between two direct repeats to facilitate easy insertion of spacers (FIG. 8). PCR products were cloned into EcoRV-digested pACYC184 downstream of the tet promoter using Gibson Assembly Master Mix (NEB). Other endogenous CRISPR system elements were omitted, with the exception of the last 50 bp of Csn2. Oligos (Integrated DNA Technology) encoding spacers with complimentary overhangs were cloned into the BsaI-digested vector pDC000 (NEB) and then ligated with T7 ligase (Enzymatics) to generate pCRISPR plasmids. Challenge plasmids containing spacers with PAM expression in mammalian cells (expression constructs illustrated in FIG. 6A, with functionality as determined by results of the Surveyor assay shown in FIG. 6B). Transcription start sites are marked as +1, and transcription terminator and the sequence probed by northern blot are also indicated. Expression of processed tracrRNA was also confirmed by Northern blot. FIG. 6C shows results of a Northern blot analysis of total RNA extracted from 293FT cells transfected with U6 expression constructs carrying long or short tracrRNA, as well as SpCas9 and DR-EMX1(1)-DR. Left and right panels are from 293FT cells transfected without or with SpRNase III, respectively. U6 indicate loading control blotted with a probe targeting human U6 snRNA. Transfection of the short tracrRNA expression construct led to abundant levels of the processed form of tracrRNA (~75 bp). Very low amounts of long tracrRNA are detected on the Northern blot.

To promote precise transcriptional initiation, the RNA polymerase III-based U6 promoter was selected to drive the expression of tracrRNA (FIG. 2C). Similarly, a U6 promoter-based construct was developed to express a pre-crRNA array consisting of a single spacer flanked by two direct repeats (DRs, also encompassed by the term "tracr-mate sequences"; FIG. 2C). The initial spacer was designed to target a 33-base-pair (bp) target site (30-bp protospacer plus a 3-bp CRISPR motif (PAM) sequence satisfying the NGG recognition motif of Cas9) in the human EMX1 locus (FIG. 2C), a key gene in the development of the cerebral cortex.

Figure 2D:
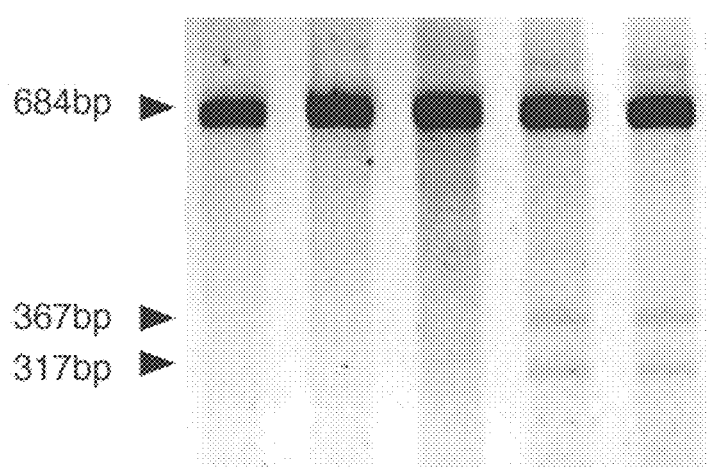
Figures 2E, 2F:
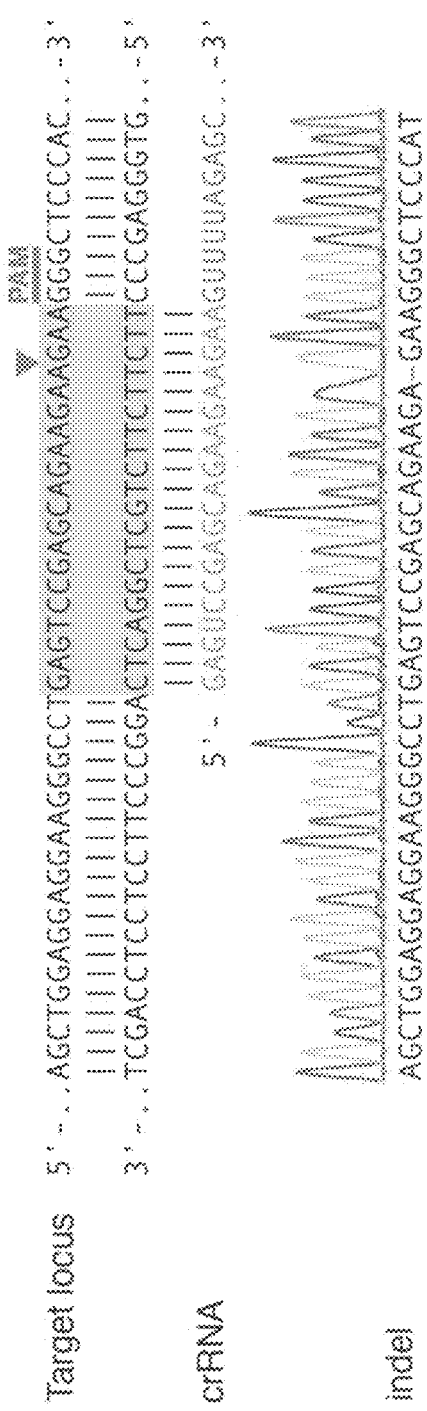

To test whether heterologous expression of the CRISPR system (SpCas9, SpRNase III, tracrRNA, and pre-crRNA) in mammalian cells can achieve targeted cleavage of mammalian chromosomes, HEK 293FT cells were transfected with combinations of CRISPR components. Since DSBs in mammalian nuclei are partially repaired by the non-homologous end joining (NHEJ) pathway, which leads to the formation of indels, the Surveyor assay was used to detect potential cleavage activity at the target EMX1 locus (FIG. 7) (see e.g. Guschin et al., 2010, Methods Mol Biol 649: 247). Co-transfection of all four CRISPR components was able to induce up to 5.0% cleavage in the protospacer (see FIG. 2D). Co-transfection of all CRISPR components minus SpRNase III also induced up to 4.7% indel in the protospacer, suggesting that there may be endogenous mammalian RNases that are capable of assisting with crRNA maturation, such as for example the related Dicer and Drosha enzymes. Removing any of the remaining three components abolished the genome cleavage activity of the CRISPR system (FIG. 2D). Sanger sequencing of amplicons containing the target locus verified the cleavage activity: in 43 sequenced clones, 5 mutated alleles (11.6%) were found. Similar experiments using a variety of guide sequences produced indel percentages as high as 29% (see FIGS. 3-6, 10, and 11). These results define a three-component system for efficient CRISPR-mediated genome modification in mammalian cells. To optimize the cleavage efficiency, Applicants also tested whether different isoforms of tracrRNA affected the cleavage efficiency and found that, in this example system, only the short (89-bp) transcript form was able to mediate cleavage of the human EMX1 genomic locus (FIG. 6B).

Figure 12A:
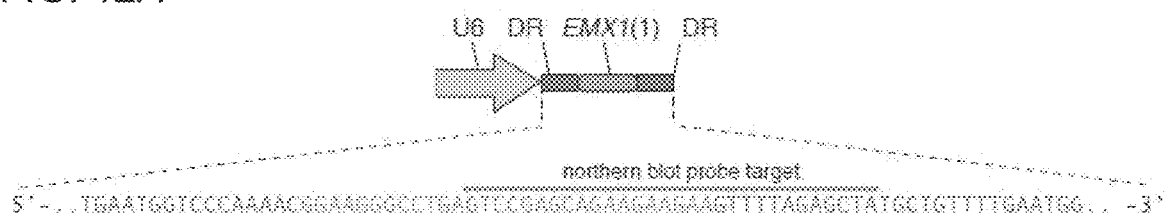
FIG. 12A-B shows the results of a Northern blot analysis of crRNA processing in mammalian cells.
Figure 12B:
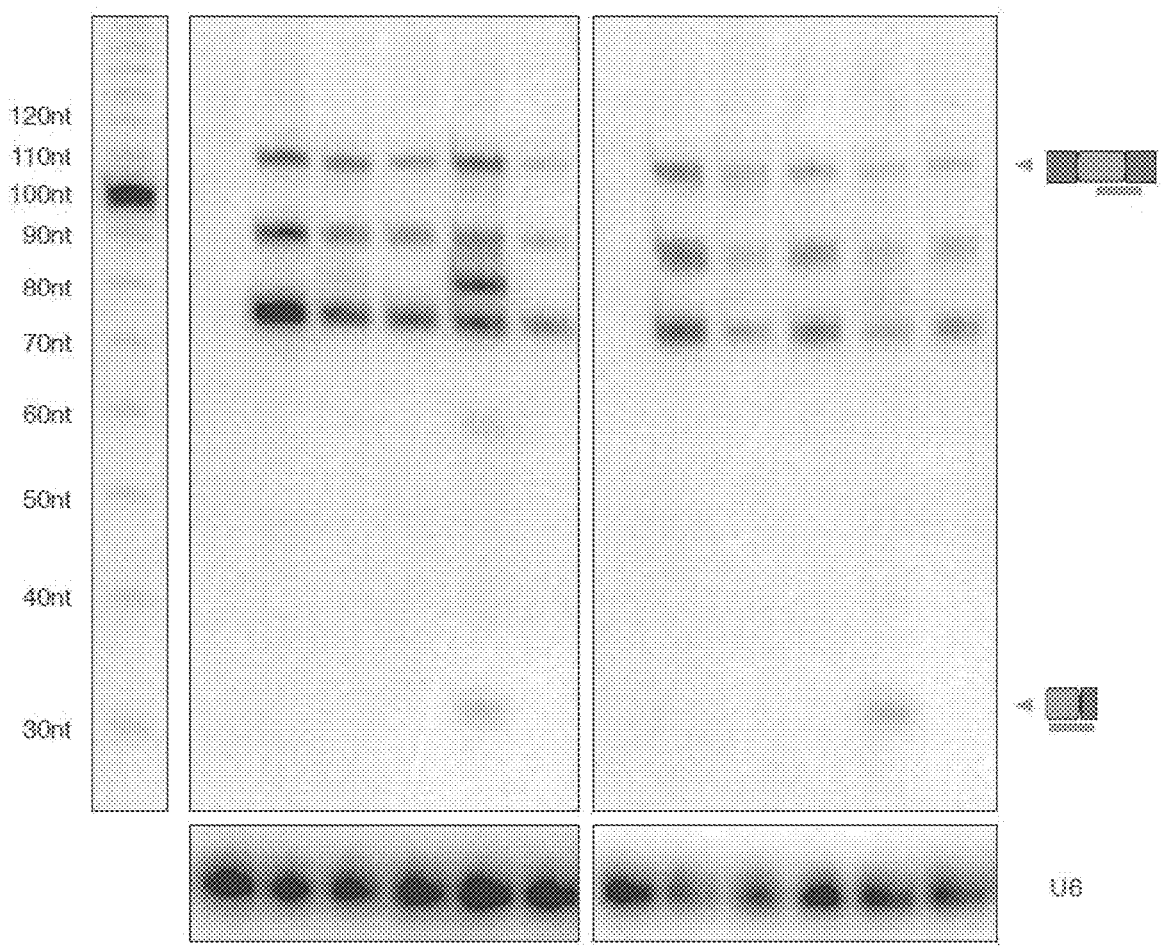

FIG. 12 provides an additional Northern blot analysis of crRNA processing in mammalian cells. FIG. 12A illustrates a schematic showing the expression vector for a single spacer flanked by two direct repeats (DR-EMX1(1)-DR). The 30 bp spacer targeting the human EMX1 locus protospacer 1 (see FIG. 6) and the direct repeat sequences are shown in the sequence beneath FIG. 12A. The line indicates the region whose reverse-complement sequence was used to generate Northern blot probes for EMX1(1) crRNA detection. FIG. 12B shows a Northern blot analysis of total RNA extracted from 293FT cells transfected with U6 expression constructs carrying DR-EMX1(1)-DR. Left and right panels are from 293FT cells transfected without or with SpRNase III respectively. DR-EMX1(1)-DR was processed into mature crRNAs only in the presence of SpCas9 and short tracrRNA and was not dependent on the presence of SpRNase III. The mature crRNA detected from transfected 293FT total RNA is –33 bp and is shorter than the 39-42 bp mature crRNA from *S. pyogenes*. These results demonstrate that a CRISPR system can be transplanted into eukaryotic cells and reprogrammed to facilitate cleavage of endogenous mammalian target polynucleotides.

FIG. 2 illustrates the bacterial CRISPR system described in this example. FIG. 2A illustrates a schematic showing the CRISPR locus 1 from *Streptococcus pyogenes* SF370 and a proposed mechanism of CRISPR-mediated DNA cleavage by this system. Mature crRNA processed from the direct repeat-spacer array directs Cas9 to genomic targets consisting of complimentary protospacers and a protospacer-adjacent motif (PAM). Upon target-spacer base pairing, Cas9 mediates a double-strand break in the target DNA. FIG. 2B illustrates engineering of *S. pyogenes* Cas9 (SpCas9) and RNase III (SpRNase III) with nuclear localization signals (NLSs) to enable import into the mammalian nucleus. FIG. 2C illustrates mammalian expression of SpCas9 and SpRNase III driven by the constitutive EF1α promoter and tracrRNA and pre-crRNA array (DR-Spacer-DR) driven by the RNA Pol3 promoter U6 to promote precise transcription initiation and termination. A protospacer from the human EMX1 locus with a satisfactory PAM sequence is used as the spacer in the pre-crRNA array. FIG. 2D illustrates surveyor nuclease assay for SpCas9-mediated minor insertions and deletions. SpCas9 was expressed with and without SpRNase III, tracrRNA, and a pre-crRNA array carrying the EMX1-target spacer. FIG. 2E illustrates a schematic representation of base pairing between target locus and EMX1-targeting crRNA, as well as an example chromatogram showing a micro deletion adjacent to the SpCas9 cleavage site. FIG. 2F illustrates mutated alleles identified from sequencing analysis of 43 clonal amplicons showing a variety of micro insertions and deletions. Dashes indicate deleted bases, and non-aligned or mismatched bases indicate insertions or mutations. Scale bar=10 μm.

To further simplify the three-component system, a chimeric crRNA-tracrRNA hybrid design was adapted, where a mature crRNA (comprising a guide sequence) may be fused to a partial tracrRNA via a stem-loop to mimic the natural crRNA:tracrRNA duplex. To increase co-delivery efficiency, a bicistronic expression vector was created to drive co-expression of a chimeric RNA and SpCas9 in transfected cells. In parallel, the bicistronic vectors were used to express a pre-crRNA (DR-guide sequence-DR) with SpCas9, to induce processing into crRNA with a separately expressed tracrRNA (compare FIG. 11B top and bottom). FIG. 8 provides schematic illustrations of bicistronic expression vectors for pre-crRNA array (FIG. 8A) or chimeric crRNA (represented by the short line downstream of the guide sequence insertion site and upstream of the EF1α promoter in FIG. 8B) with hSpCas9, showing location of various elements and the point of guide sequence insertion. The expanded sequence around the location of the guide sequence insertion site in FIG. 8B also shows a partial DR sequence (GTTTTAGAGCTA (SEQ ID NO: 1470)) and a partial tracrRNA sequence (TAGCAAGT-TAAAATAAGGCTAGTCCGTTTTT (SEQ ID NO: 1471)). Guide sequences can be inserted between BbsI sites using annealed oligonucleotides. Sequence design for the oligonucleotides are shown below the schematic illustrations in FIG. 8, with appropriate ligation adapters indicated. WPRE represents the Woodchuck hepatitis virus post-transcriptional regulatory element. The efficiency of chimeric RNA-mediated cleavage was tested by targeting the same EMX1 locus described above. Using both Surveyor assay and Sanger sequencing of amplicons, Applicants confirmed that the chimeric RNA design facilitates cleavage of human EMX1 locus with approximately a 4.7% modification rate (FIG. 3).

Figures 13A, 13B:
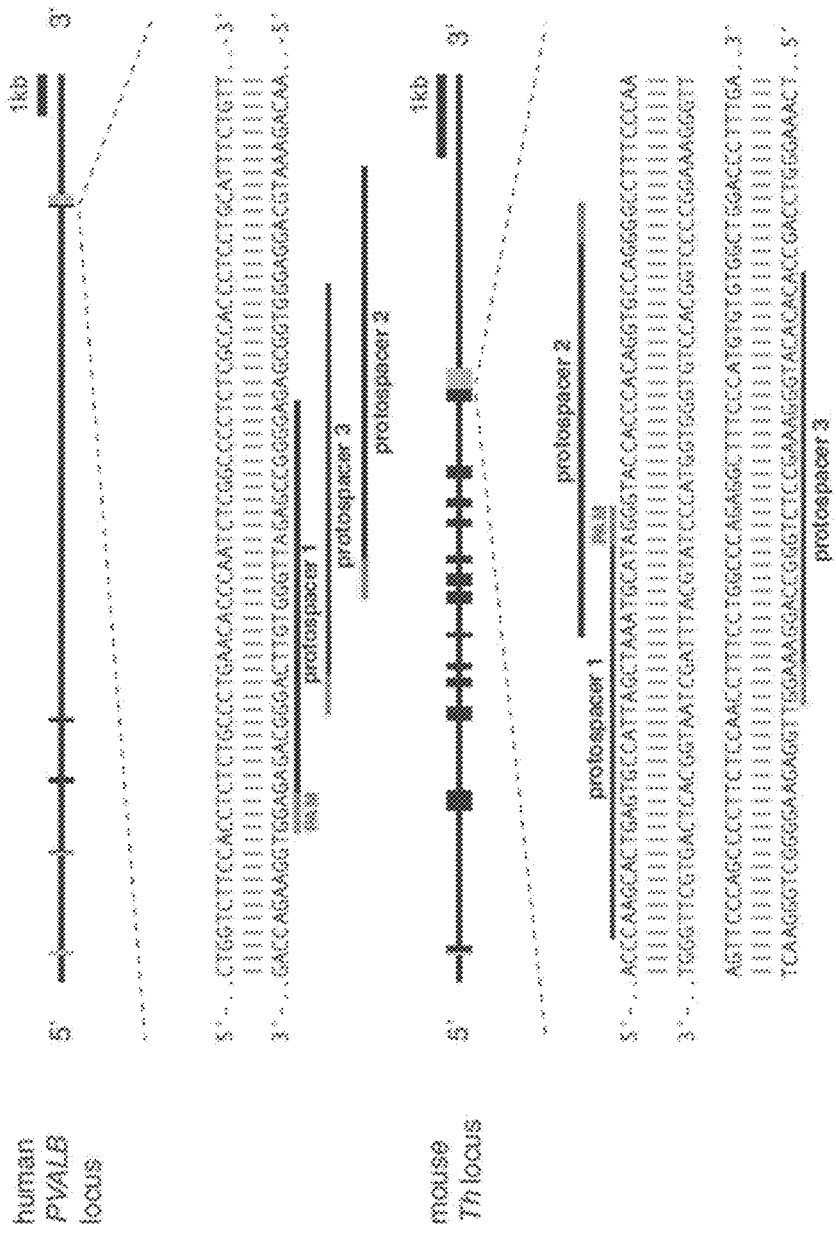
FIG. 13A-B shows an exemplary selection of protospacers in the human PVALB (SEQ ID NO: 1641) and mouse Th loci (SEQ ID NO: 1642).

Generalizability of CRISPR-mediated cleavage in eukaryotic cells was tested by targeting additional genomic loci in both human and mouse cells by designing chimeric RNA targeting multiple sites in the human EMX1 and PVALB, as well as the mouse Th loci. FIG. 13 illustrates the selection of some additional targeted protospacers in human PVALB (FIG. 13A) and mouse Th (FIG. 13B) loci. Schematics of the gene loci and the location of three protospacers within the last exon of each are provided. The underlined sequences include 30 bp of protospacer sequence and 3 bp at the 3' end corresponding to the PAM sequences. Protospacers on the sense and anti-sense strands are indicated above and below the DNA sequences, respectively. A modification rate of 6.3% and 0.75% was achieved for the human PVALB and mouse Th loci respectively, demonstrating the broad applicability of the CRISPR system in modifying different loci across multiple organisms (FIG. 5). While cleavage was only detected with one out of three spacers for each locus using the chimeric constructs, all target sequences were cleaved with efficiency of indel production reaching 27% when using the co-expressed pre-crRNA arrangement (FIGS. 6 and 13).

FIG. 11 provides a further illustration that SpCas9 can be reprogrammed to target multiple genomic loci in mammalian cells. FIG. 11A provides a schematic of the human EMX1 locus showing the location of five protospacers, indicated by the underlined sequences. FIG. 11B provides a schematic of the pre-crRNA/trcrRNA complex showing hybridization between the direct repeat region of the pre-crRNA and tracrRNA (top), and a schematic of a chimeric RNA design comprising a 20 bp guide sequence, and tracr mate and tracr sequences consisting of partial direct repeat and tracrRNA sequences hybridized in a hairpin structure (bottom). Results of a Surveyor assay comparing the efficacy of Cas9-mediated cleavage at five protospacers in the human EMX1 locus is illustrated in FIG. 11C. Each protospacer is targeted using either processed pre-crRNA/tracrRNA complex (crRNA) or chimeric RNA (chiRNA).

Since the secondary structure of RNA can be crucial for intermolecular interactions, a structure prediction algorithm based on minimum free energy and Boltzmann-weighted structure ensemble was used to compare the putative secondary structure of all guide sequences used in the genome targeting experiment (see e.g. Gruber et al., 2008, Nucleic Acids Research, 36: W70). Analysis revealed that in most cases, the effective guide sequences in the chimeric crRNA context were substantially free of secondary structure motifs, whereas the ineffective guide sequences were more likely to form internal secondary structures that could prevent base pairing with the target protospacer DNA. It is thus possible that variability in the spacer secondary structure might impact the efficiency of CRISPR-mediated interference when using a chimeric crRNA.

Figure 22A:
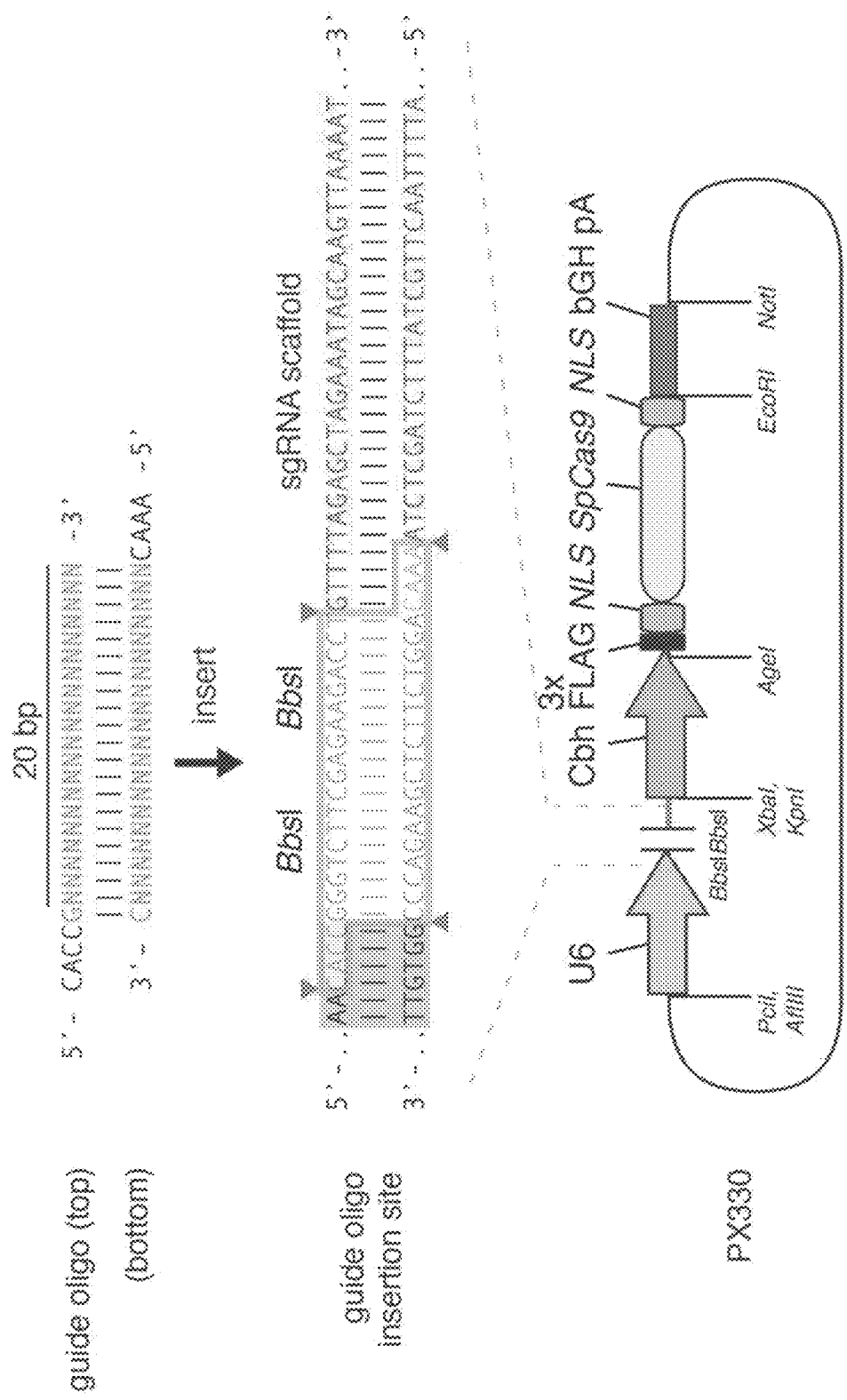
FIG. 22A-B shows single vector designs for SpCas9.
Figure 22B:
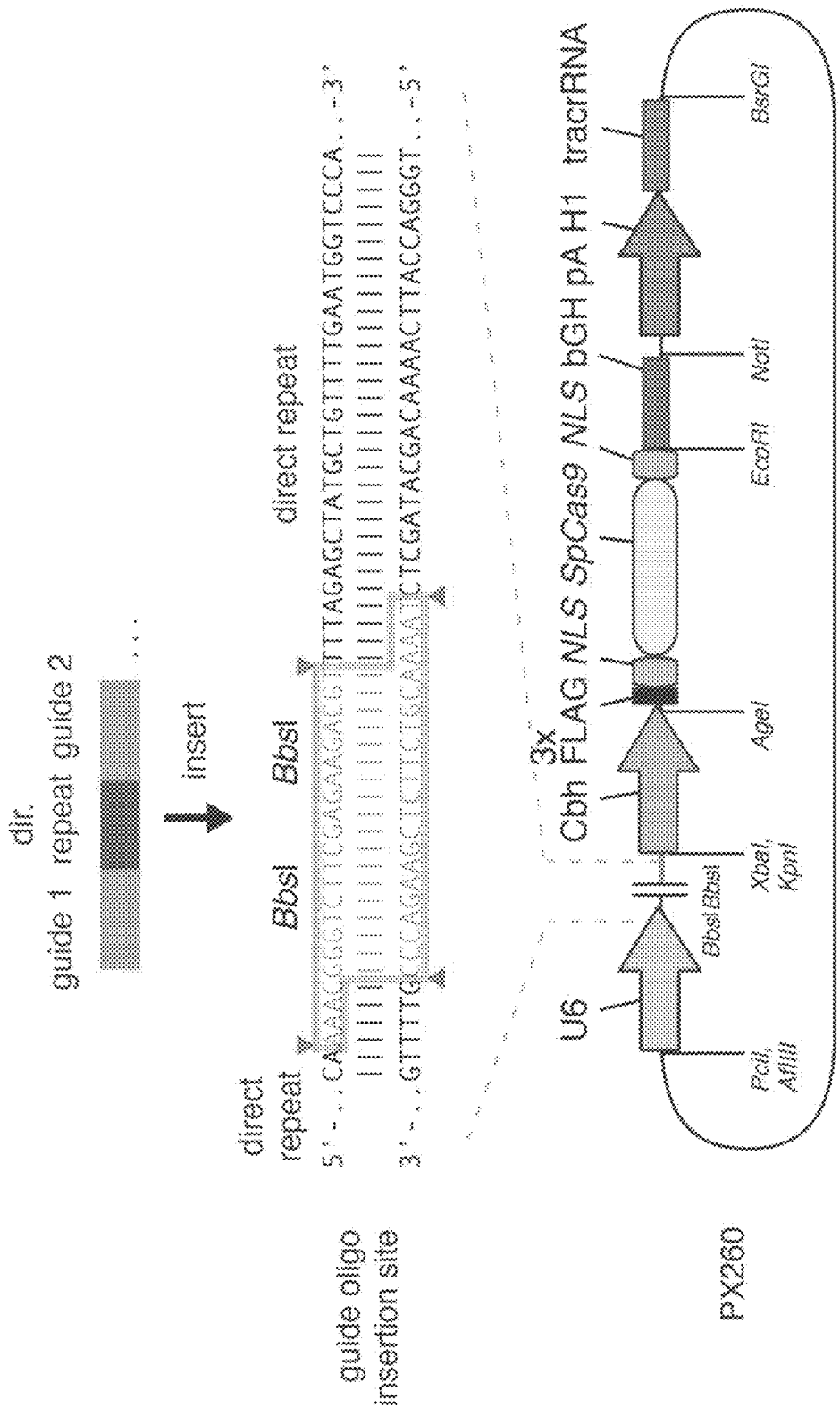

Further vector designs for SpCas9 are shown in FIG. 22, which illustrates single expression vectors incorporating a U6 promoter linked to an insertion site for a guide oligo, and a Cbh promoter linked to SpCas9 coding sequence. The vector shown in FIG. 22b includes a tracrRNA coding sequence linked to an H1 promoter.

In the bacterial assay, all spacers facilitated efficient CRISPR interference (FIG. 3C). These results suggest that there may be additional factors affecting the efficiency of CRISPR activity in mammalian cells.

Figure 3D:
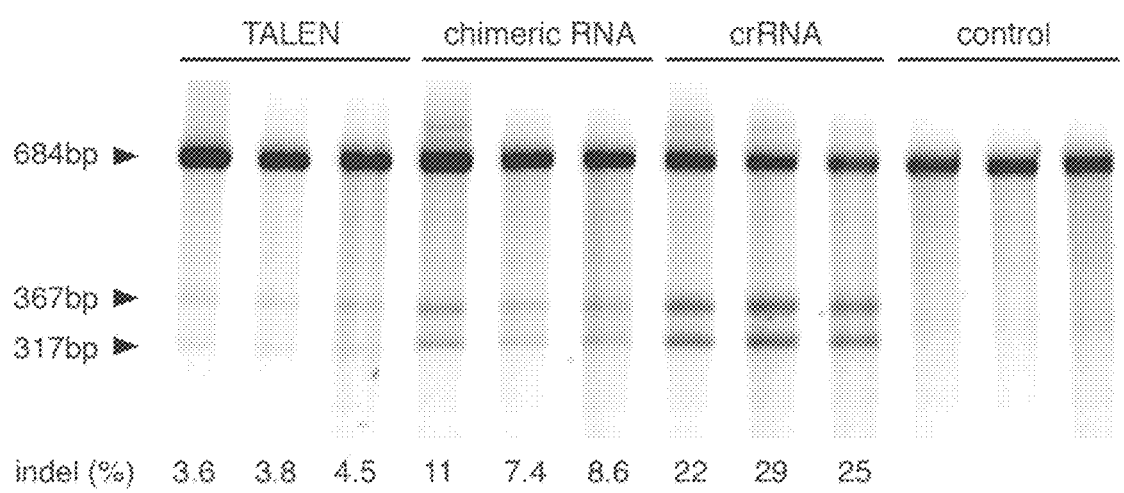

To investigate the specificity of CRISPR-mediated cleavage, the effect of single-nucleotide mutations in the guide sequence on protospacer cleavage in the mammalian genome was analyzed using a series of EMX1-targeting chimeric crRNAs with single point mutations (FIG. 3A). FIG. 3B illustrates results of a Surveyor nuclease assay comparing the cleavage efficiency of Cas9 when paired with different mutant chimeric RNAs. Single-base mismatch up to 12-bp 5' of the PAM substantially abrogated genomic cleavage by SpCas9, whereas spacers with mutations at farther upstream positions retained activity against the original protospacer target (FIG. 3B). In addition to the PAM, SpCas9 has single-base specificity within the last 12-bp of the spacer. Furthermore, CRISPR is able to mediate genomic cleavage as efficiently as a pair of TALE nucleases (TALEN) targeting the same EMX1 protospacer. FIG. 3C provides a schematic showing the design of TALENs targeting EMX1, and FIG. 3D shows a Surveyor gel comparing the efficiency of TALEN and Cas9 (n=3).

Having established a set of components for achieving CRISPR-mediated gene editing in mammalian cells through the error-prone NHEJ mechanism, the ability of CRISPR to stimulate homologous recombination (HR), a high fidelity gene repair pathway for making precise edits in the genome, was tested. The wild type SpCas9 is able to mediate site-specific DSBs, which can be repaired through both NHEJ and HR. In addition, an aspartate-to-alanine substitution (D10A) in the RuvC I catalytic domain of SpCas9 was engineered to convert the nuclease into a nickase (SpCas9n; illustrated in FIG. 4A) (see e.g. Sapranausaks et al., 2011, Nucleic Acids Resch, 39: 9275; Gasiunas et al., 2012, Proc.

Figure 4A:
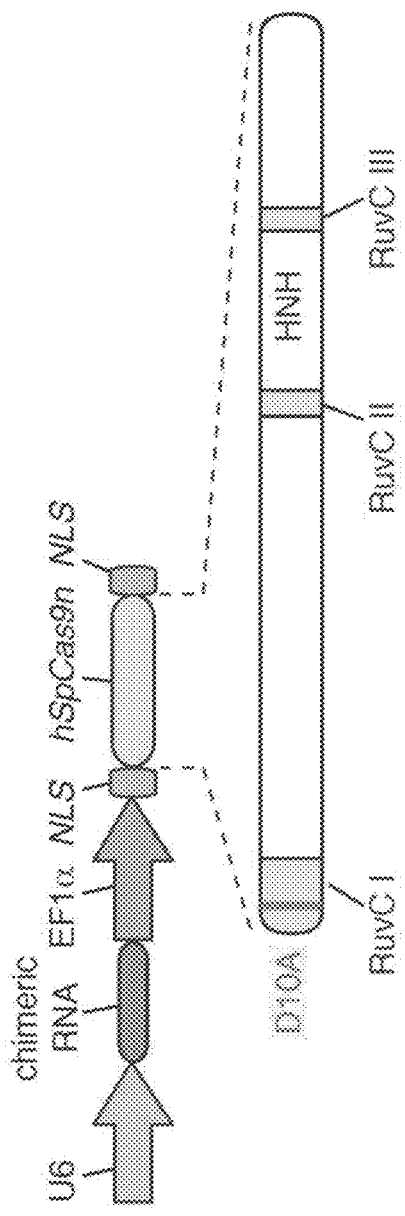
FIG. 4A-G show an exemplary vector system and results for its use in directing homologous recombination in eukaryotic cells.
Figure 4B:
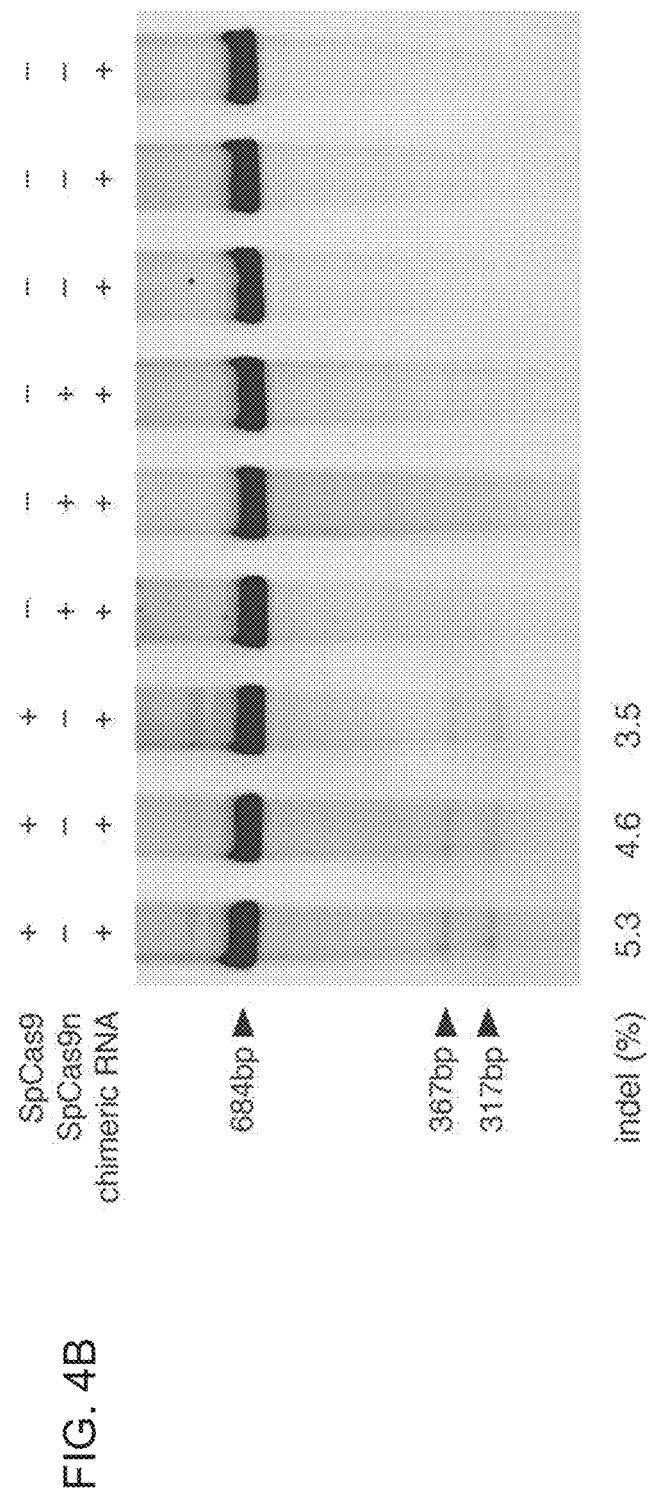
Figure 4C:
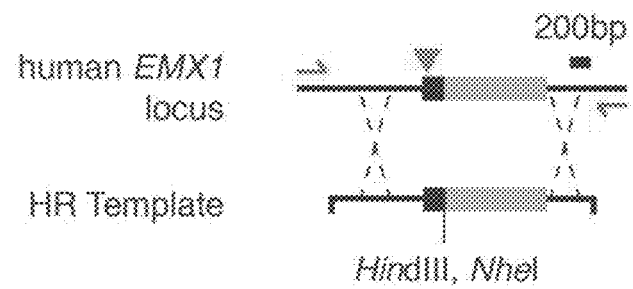
Figure 4D:
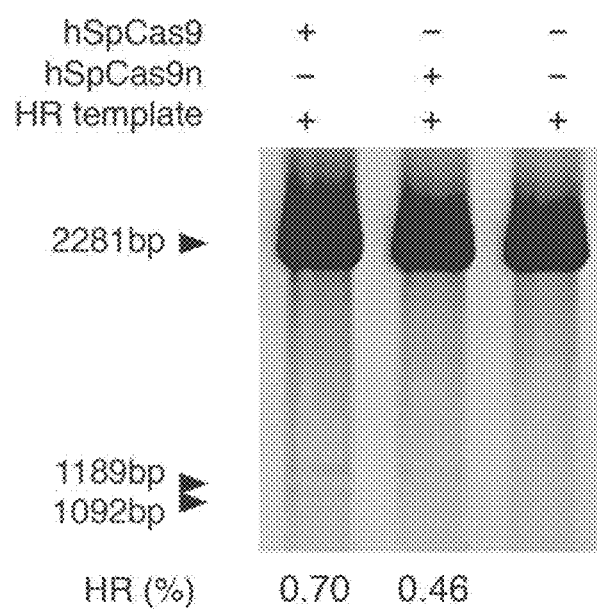
Figure 4E:
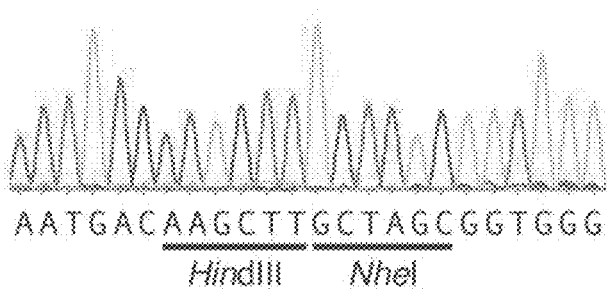

Natl. Acad. Sci. USA, 109:E2579), such that nicked genomic DNA undergoes the high-fidelity homology-directed repair (HDR). Surveyor assay confirmed that SpCas9n does not generate indels at the EMX1 protospacer target. As illustrated in FIG. 4B, co-expression of EMX1-targeting chimeric crRNA with SpCas9 produced indels in the target site, whereas co-expression with SpCas9n did not (n=3). Moreover, sequencing of 327 amplicons did not detect any indels induced by SpCas9n. The same locus was selected to test CRISPR-mediated HR by co-transfecting HEK 293FT cells with the chimeric RNA targeting EMX1, hSpCas9 or hSpCas9n, as well as a HR template to introduce a pair of restriction sites (HindIII and NheI) near the protospacer. FIG. 4C provides a schematic illustration of the HR strategy, with relative locations of recombination points and primer annealing sequences (arrows). SpCas9 and SpCas9n indeed catalyzed integration of the HR template into the EMX1 locus. PCR amplification of the target region followed by restriction digest with HindIII revealed cleavage products corresponding to expected fragment sizes (arrows in restriction fragment length polymorphism gel analysis shown in FIG. 4D), with SpCas9 and SpCas9n mediating similar levels of HR efficiencies. Applicants further verified HR using Sanger sequencing of genomic amplicons (FIG. 4E). These results demonstrate the utility of CRISPR for facilitating targeted gene insertion in the mammalian genome. Given the 14-bp (12-bp from the spacer and 2-bp from the PAM) target specificity of the wild type SpCas9, the availability of a nickase can significantly reduce the likelihood of off-target modifications, since single strand breaks are not substrates for the error-prone NHEJ pathway.

Figure 4F:
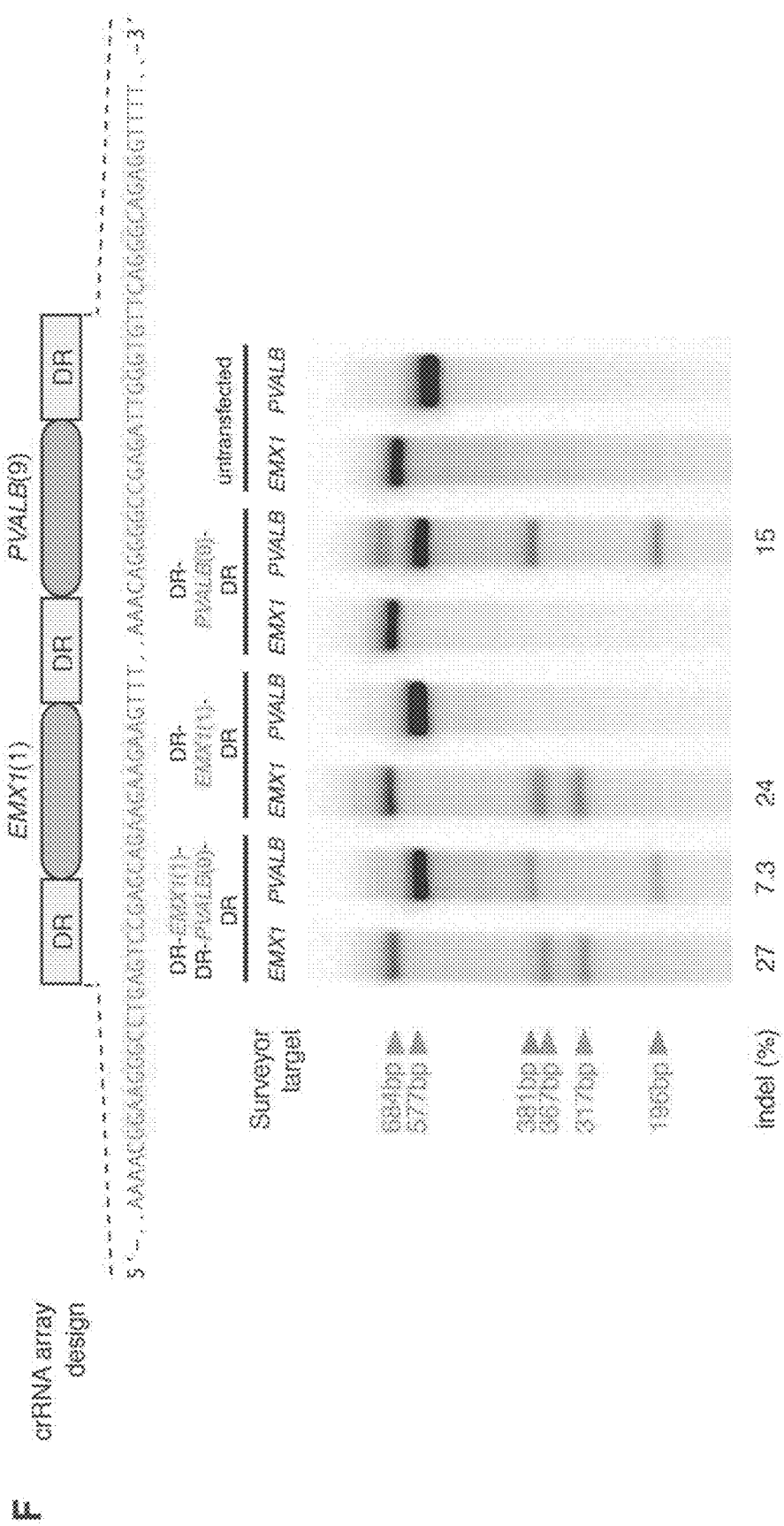
Figure 4G:
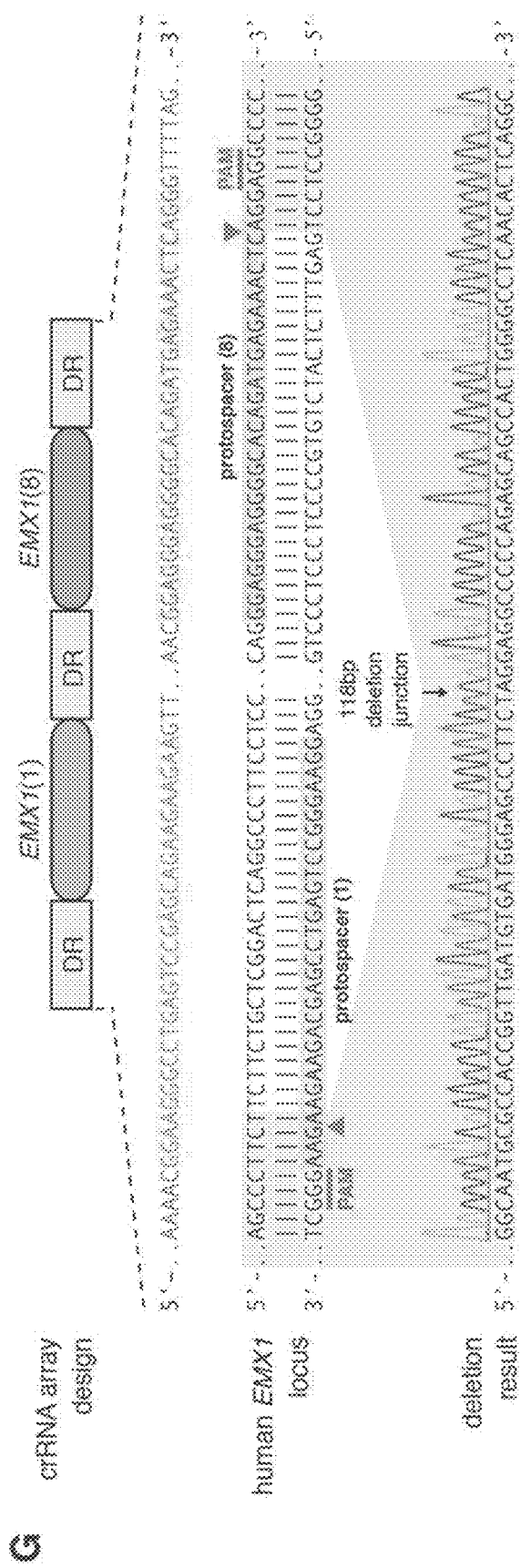

Expression constructs mimicking the natural architecture of CRISPR loci with arrayed spacers (FIG. 2A) were constructed to test the possibility of multiplexed sequence targeting. Using a single CRISPR array encoding a pair of EMX1- and PVALB-targeting spacers, efficient cleavage at both loci was detected (FIG. 4F, showing both a schematic design of the crRNA array and a Surveyor blot showing efficient mediation of cleavage). Targeted deletion of larger genomic regions through concurrent DSBs using spacers against two targets within EMX1 spaced by 119 bp was also tested, and a 1.6% deletion efficacy (3 out of 182 amplicons; FIG. 4G) was detected. This demonstrates that the CRISPR system can mediate multiplexed editing within a single genome.

Example 2: CRISPR System Modifications and Alternatives

Figure 10A:
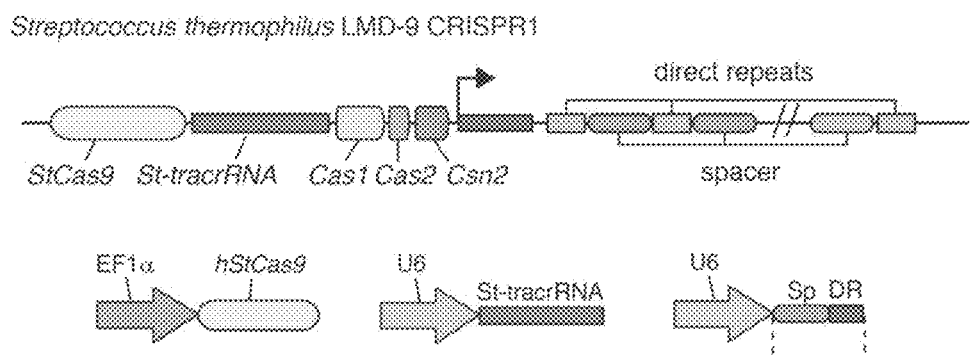
FIG. 10A-D shows an exemplary CRISPR system, an example adaptation for expression in eukaryotic cells, and results of tests assessing CRISPR activity.
Figure 10B:
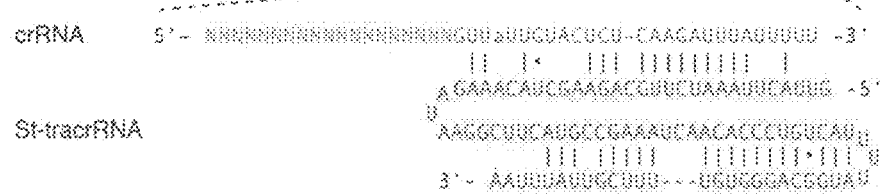
Figure 10C:
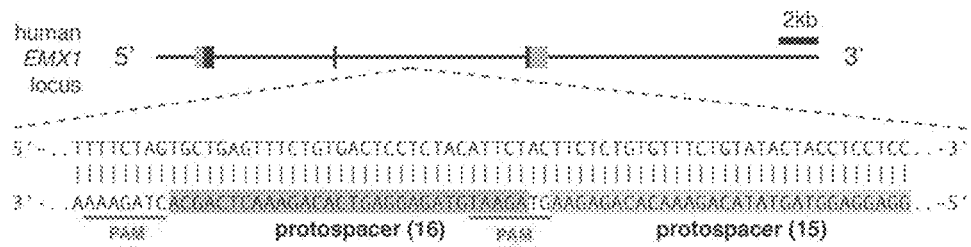
Figure 10D:
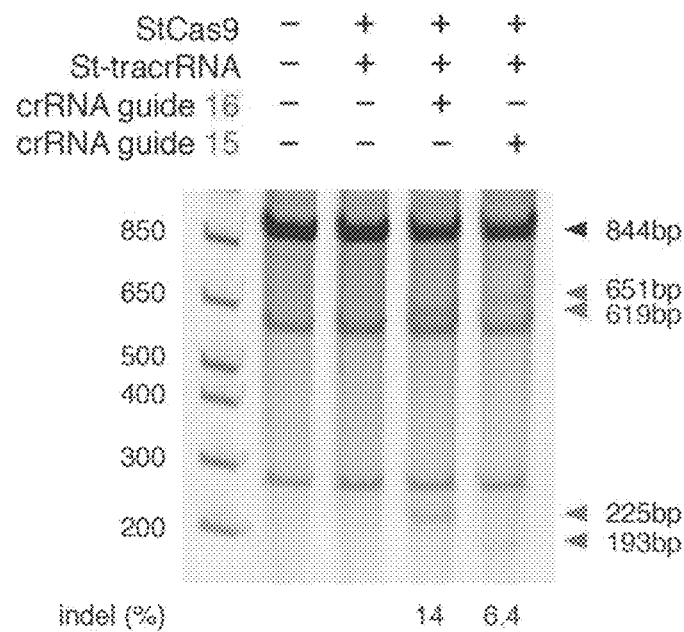
Figure 14:
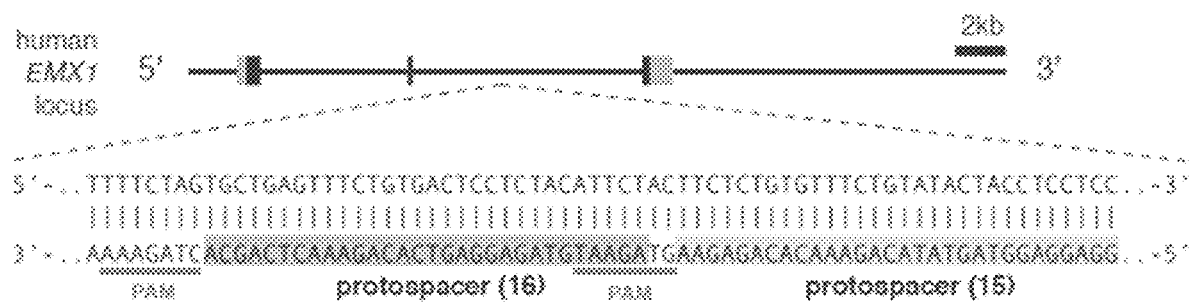
FIG. 14 shows example protospacer and corresponding PAM sequence targets of the *S. thermophilus* CRISPR system in the human EMX1 locus.

The ability to use RNA to program sequence-specific DNA cleavage defines a new class of genome engineering tools for a variety of research and industrial applications. Several aspects of the CRISPR system can be further improved to increase the efficiency and versatility of CRISPR targeting. Optimal Cas9 activity may depend on the availability of free $Mg^{2+}$ at levels higher than that present in the mammalian nucleus (see e.g. Jinek et al., 2012, Science, 337:816), and the preference for an NGG motif immediately downstream of the protospacer restricts the ability to target on average every 12-bp in the human genome (FIG. 9, evaluating both plus and minus strands of human chromosomal sequences). Some of these constraints can be overcome by exploring the diversity of CRISPR loci across the microbial metagenome (see e.g. Makarova et al., 2011, Nat Rev Microbiol, 9:467). Other CRISPR loci may be transplanted into the mammalian cellular milieu by a process similar to that described in Example 1. For example, FIG. 10 illustrates adaptation of the Type II CRISPR system from CRISPR 1 of *Streptococcus thermophilus* LMD-9 for heterologous expression in mammalian cells to achieve CRISPR-mediated genome editing. FIG. 10A provides a Schematic illustration of CRISPR 1 from *S. thermophilus* LMD-9. FIG. 10B illustrates the design of an expression system for the *S. thermophilus* CRISPR system. Human codon-optimized hStCas9 is expressed using a constitutive EF1α promoter. Mature versions of tracrRNA and crRNA are expressed using the U6 promoter to promote precise transcription initiation. Sequences from the mature crRNA and tracrRNA are illustrated. A single base indicated by the lower case "a" in the crRNA sequence is used to remove the polyU sequence, which serves as a RNA polIII transcriptional terminator. FIG. 10C provides a schematic showing guide sequences targeting the human EMX1 locus. FIG. 10D shows the results of hStCas9-mediated cleavage in the target locus using the Surveyor assay. RNA guide spacers 1 and 2 induced 14% and 6.4%, respectively. Statistical analysis of cleavage activity across biological replica at these two protospacer sites is also provided in FIG. 5. FIG. 14 provides a schematic of additional protospacer and corresponding PAM sequence targets of the *S. thermophilus* CRISPR system in the human EMX1 locus. Two protospacer sequences are highlighted and their corresponding PAM sequences satisfying NNAGAAW motif are indicated by underlining 3' with respect to the corresponding highlighted sequence. Both protospacers target the anti-sense strand.

Example 3: Sample Target Sequence Selection Algorithm

A software program is designed to identify candidate CRISPR target sequences on both strands of an input DNA sequence based on desired guide sequence length and a CRISPR motif sequence (PAM) for a specified CRISPR enzyme. For example, target sites for Cas9 from *S. pyogenes*, with PAM sequences NGG, may be identified by searching for 5'-$N_x$-NGG-3' both on the input sequence and on the reverse-complement of the input. Likewise, target sites for Cas9 of *S. thermophilus* CRISPR1, with PAM sequence NNAGAAW, may be identified by searching for 5'-$N_x$-NNAGAAW-3' both on the input sequence and on the reverse-complement of the input. Likewise, target sites for Cas9 of *S. thermophilus* CRISPR3, with PAM sequence NGGNG, may be identified by searching for 5'-$N_x$-NGGNG-3' both on the input sequence and on the reverse-complement of the input. The value "x" in $N_x$ may be fixed by the program or specified by the user, such as 20.

Since multiple occurrences in the genome of the DNA target site may lead to nonspecific genome editing, after identifying all potential sites, the program filters out sequences based on the number of times they appear in the relevant reference genome. For those CRISPR enzymes for which sequence specificity is determined by a 'seed' sequence, such as the 11-12 bp 5' from the PAM sequence, including the PAM sequence itself, the filtering step may be based on the seed sequence. Thus, to avoid editing at additional genomic loci, results are filtered based on the number of occurrences of the seed:PAM sequence in the relevant genome. The user may be allowed to choose the length of the seed sequence. The user may also be allowed to specify the number of occurrences of the seed:PAM sequence in a genome for purposes of passing the filter. The default is to screen for unique sequences. Filtration level is altered by changing both the length of the seed sequence and the number of occurrences of the sequence in the genome.

Figure 18:
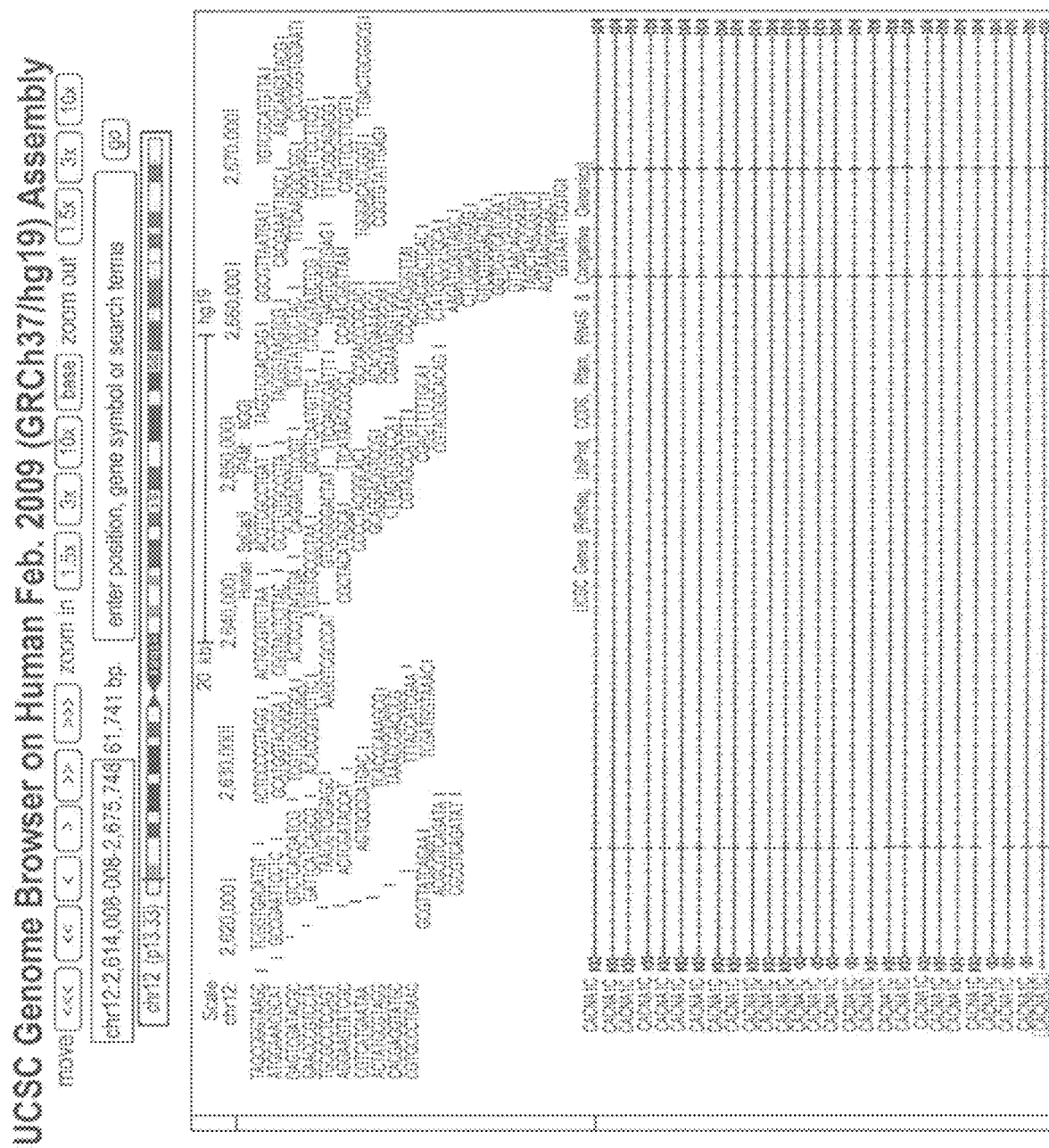
FIG. 18 shows an exemplary visualization of some *S. pyogenes* Cas9 target sites in the human genome using the UCSC genome browser.
Figure 19A:
FIG. 19A-D shows a circular depiction of the phylogenetic analysis revealing five families of Cas9s, including three groups of large Cas9s (~1400 amino acids) and two of small Cas9s (~1100 amino acids).
Figure 19B:
Figure 19C:
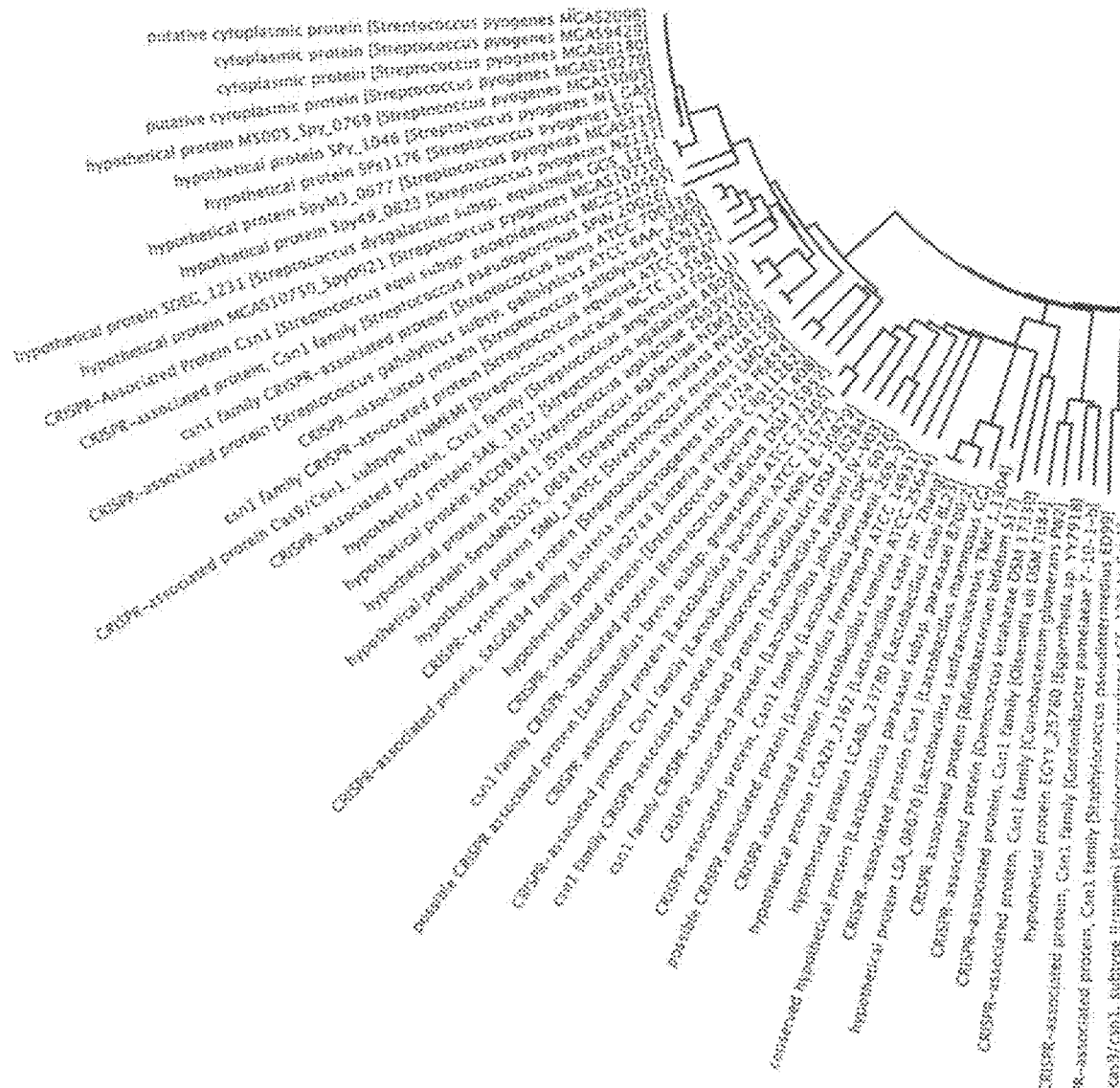
Figure 19D:
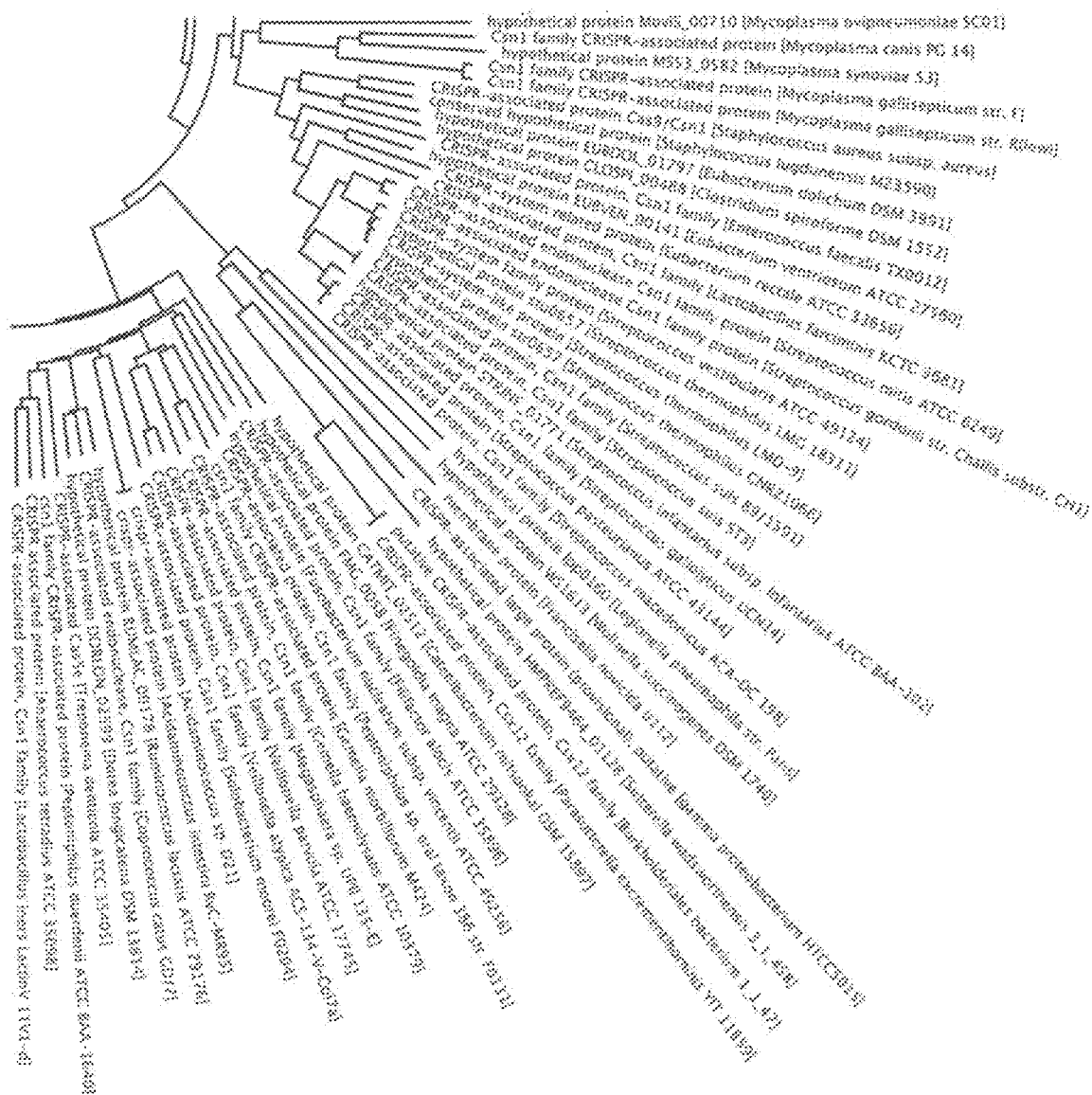
Figure 20C:
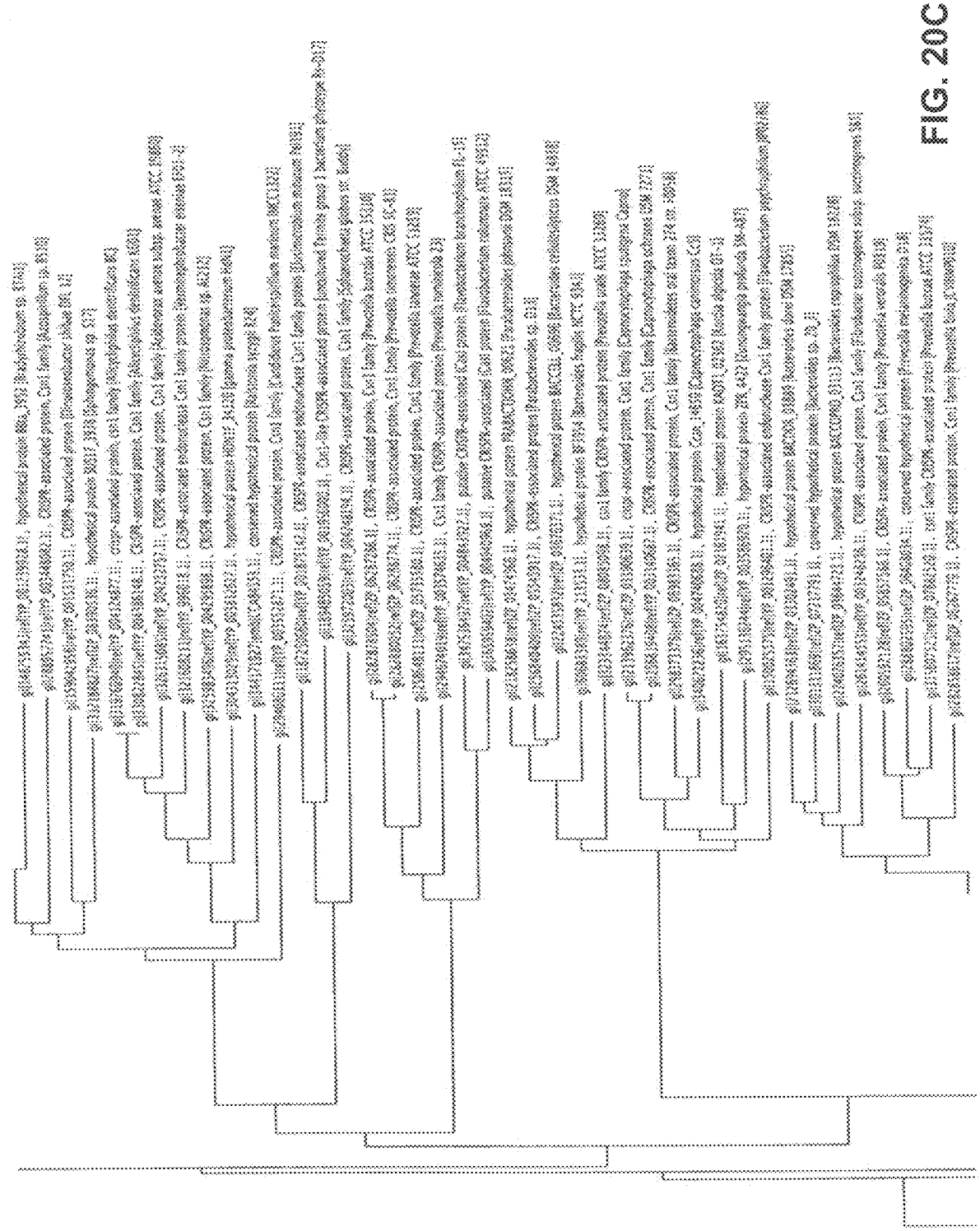
Figure 20D:
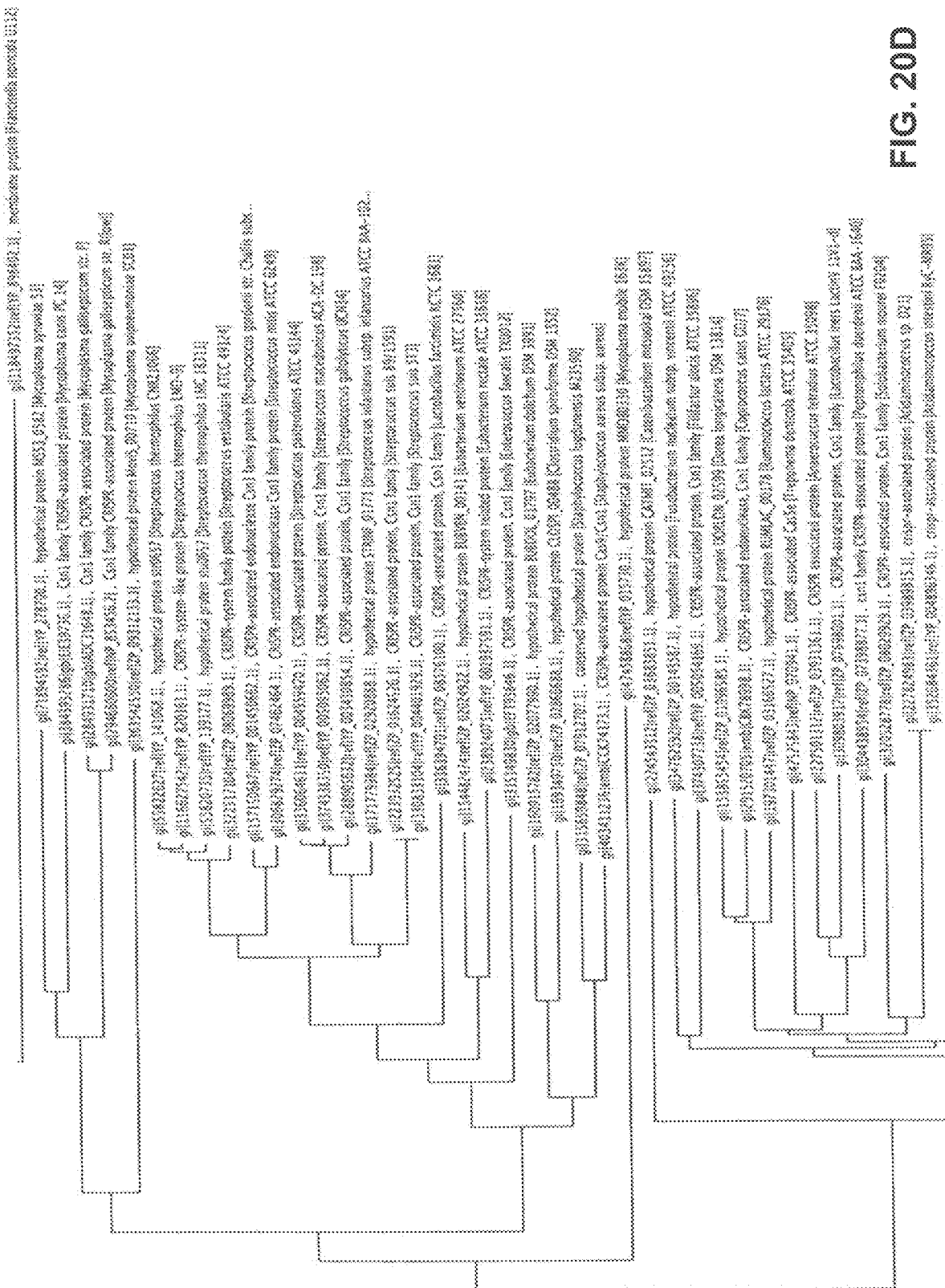
Figure 20E:
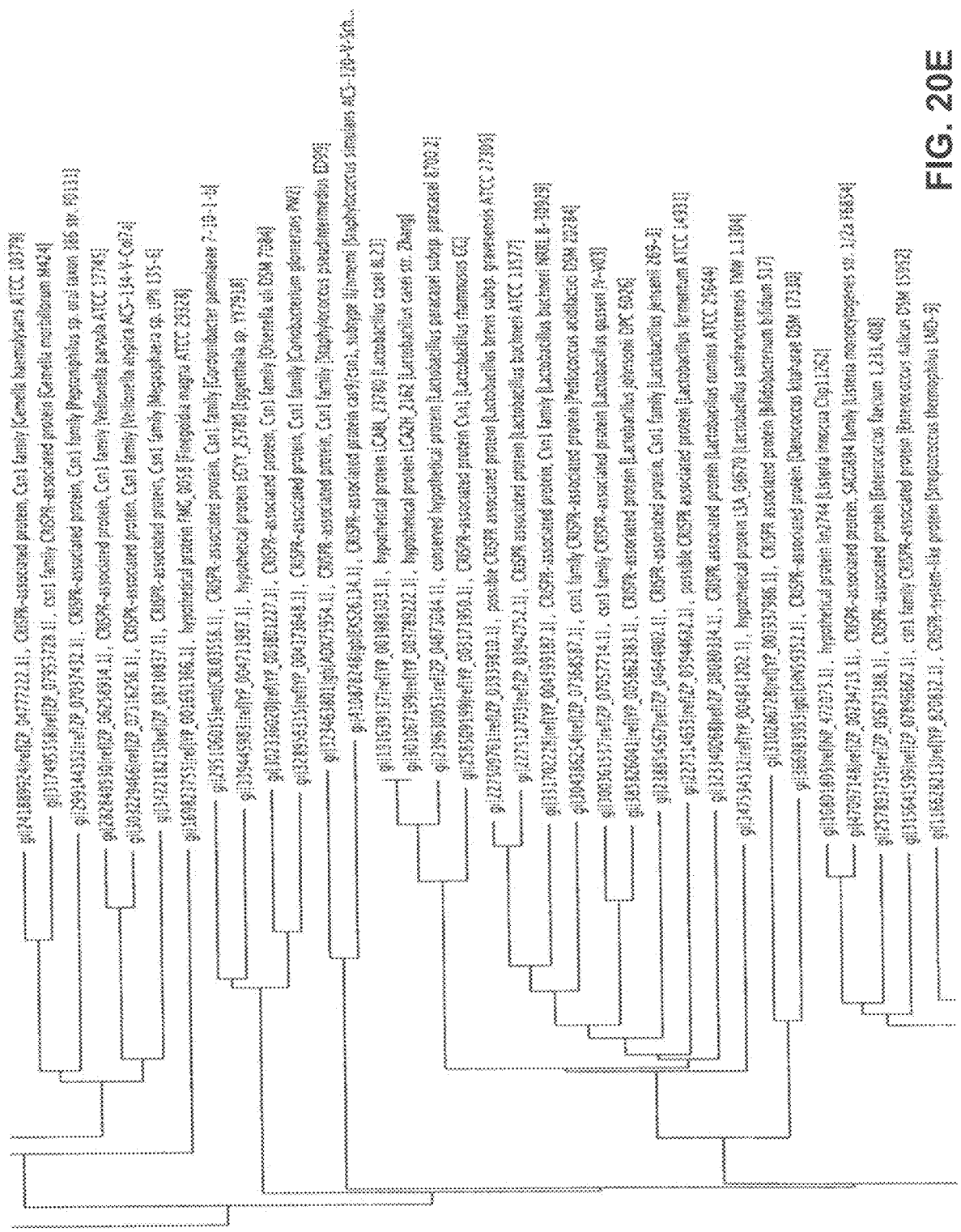
Figure 20F:
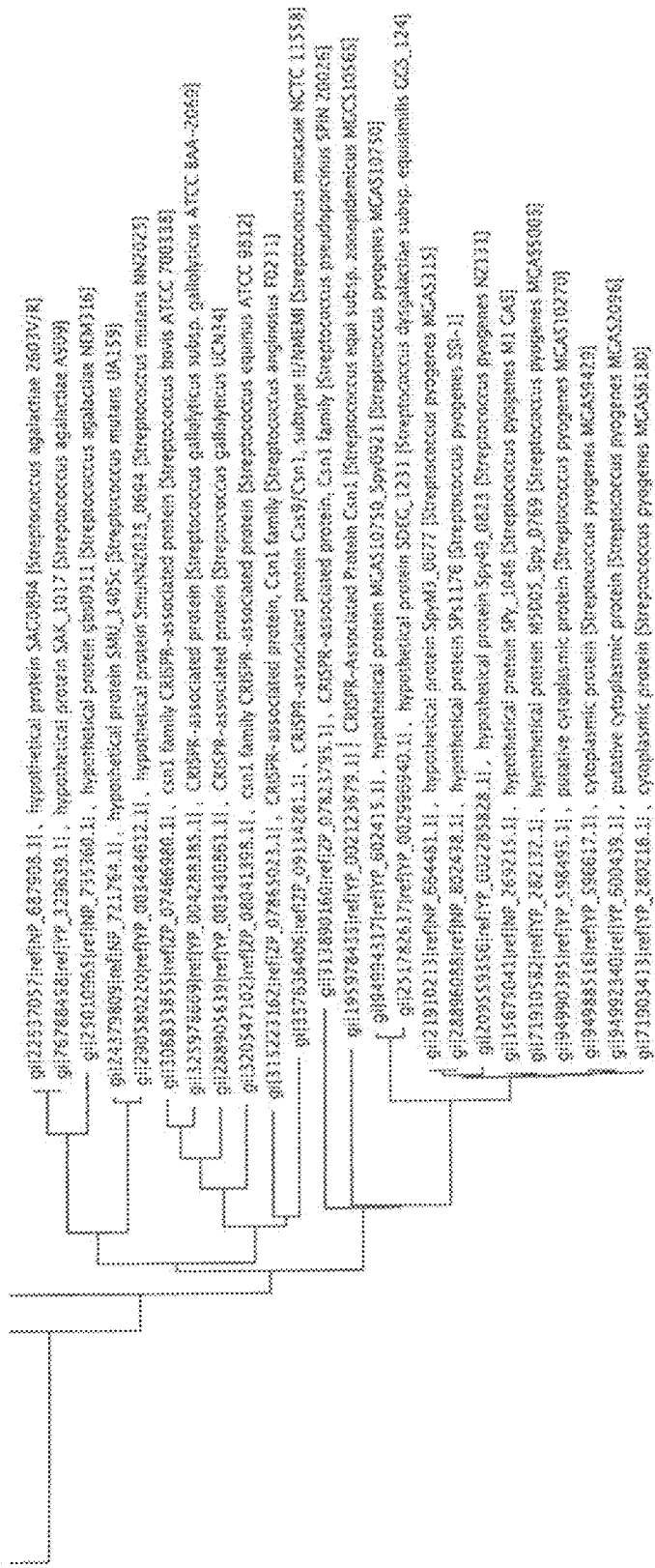
Figure 21A:
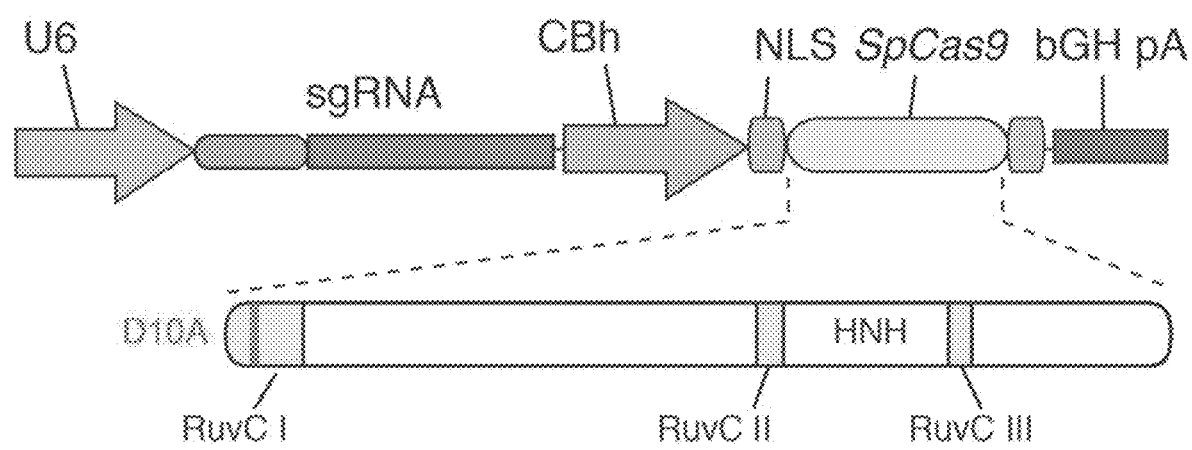
FIG. 21A-D shows genome editing via homologous recombination. (a) Schematic of SpCas9 nickase, with D10A mutation in the RuvC I catalytic domain. (b) Schematic representing homologous recombination (HR) at the human EMX1 locus using either sense or antisense single stranded oligonucleotides as repair templates. Red arrow above indicates sgRNA cleavage site; PCR primers for genotyping (Tables J and K) are indicated as arrows in right panel. (c) Sequence of region modified by HR. d, SURVEYOR assay for wildtype (wt) and nickase (D10A) SpCas9-mediated indels at the EMX1 target 1 locus (n=3). Arrows indicate positions of expected fragment sizes.
Figure 21B:
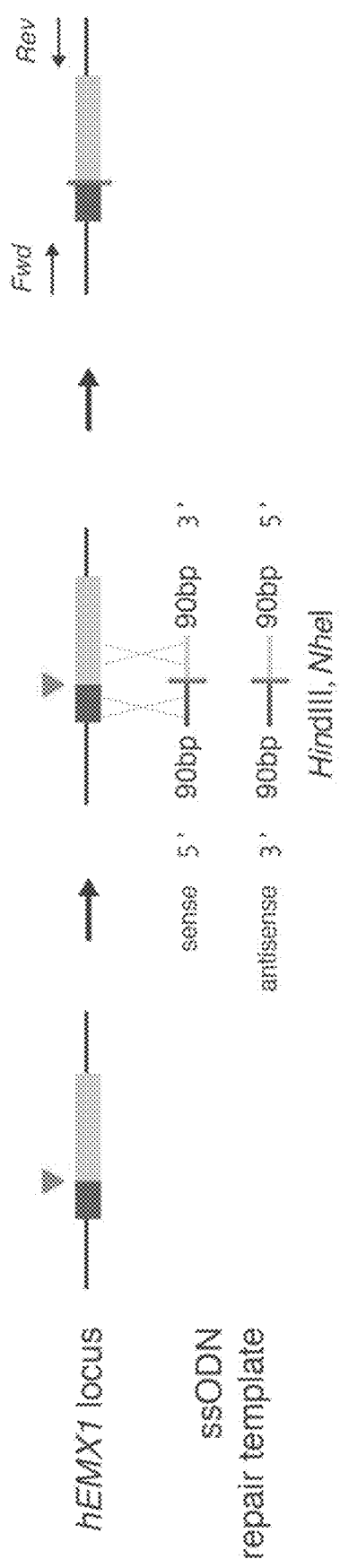
Figure 21C:
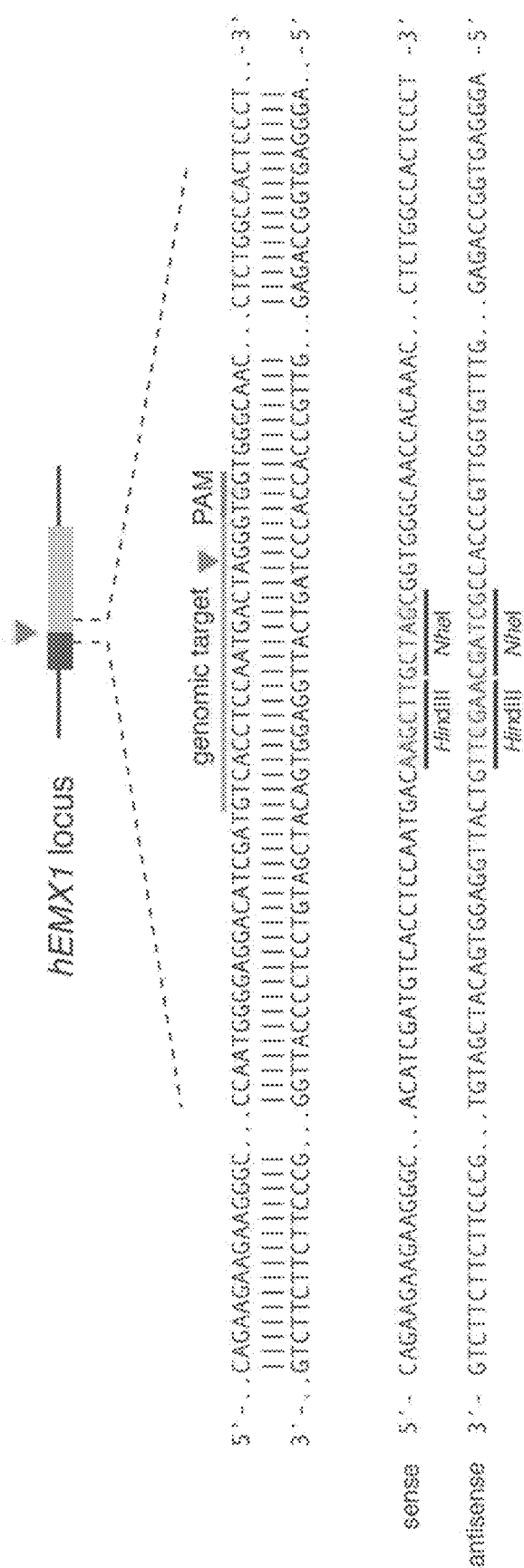
Figure 21D:
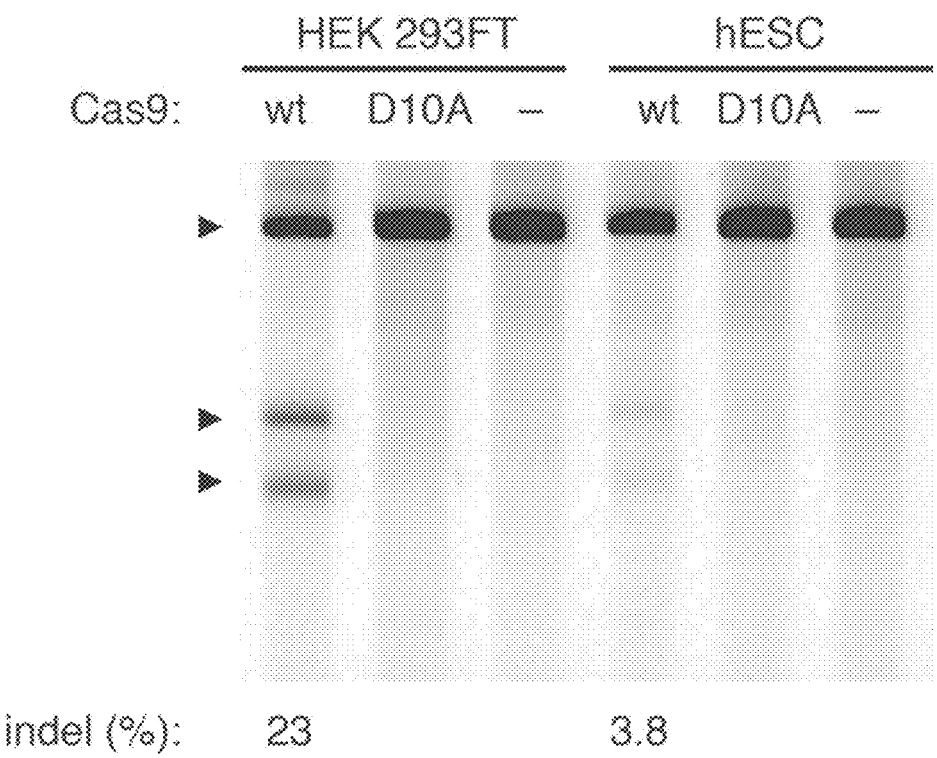

The program may in addition or alternatively provide the sequence of a guide sequence complementary to the reported target sequence(s) by providing the reverse complement of the identified target sequence(s). An example visualization of some target sites in the human genome is provided in FIG. 18.

Further details of methods and algorithms to optimize sequence selection can be found in U.S. application Ser. No. 61/064,798; Broad Reference BI-2012/084); incorporated herein by reference.

Example 4: Evaluation of Multiple Chimeric crRNA-tracrRNA Hybrids

Figure 16A:
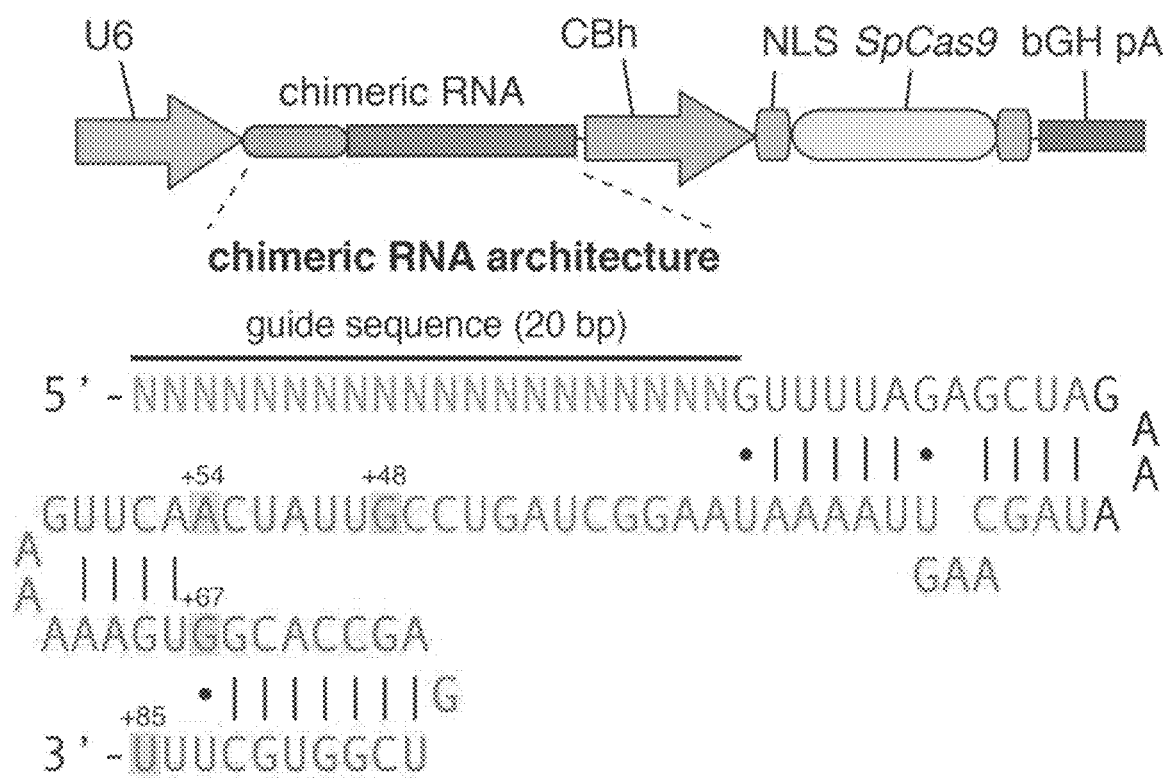
FIG. 16A-C shows exemplary manipulation of a CRISPR system with chimeric RNAs and results of SURVEYOR assays for system activity in eukaryotic cells.
Figure 16B:
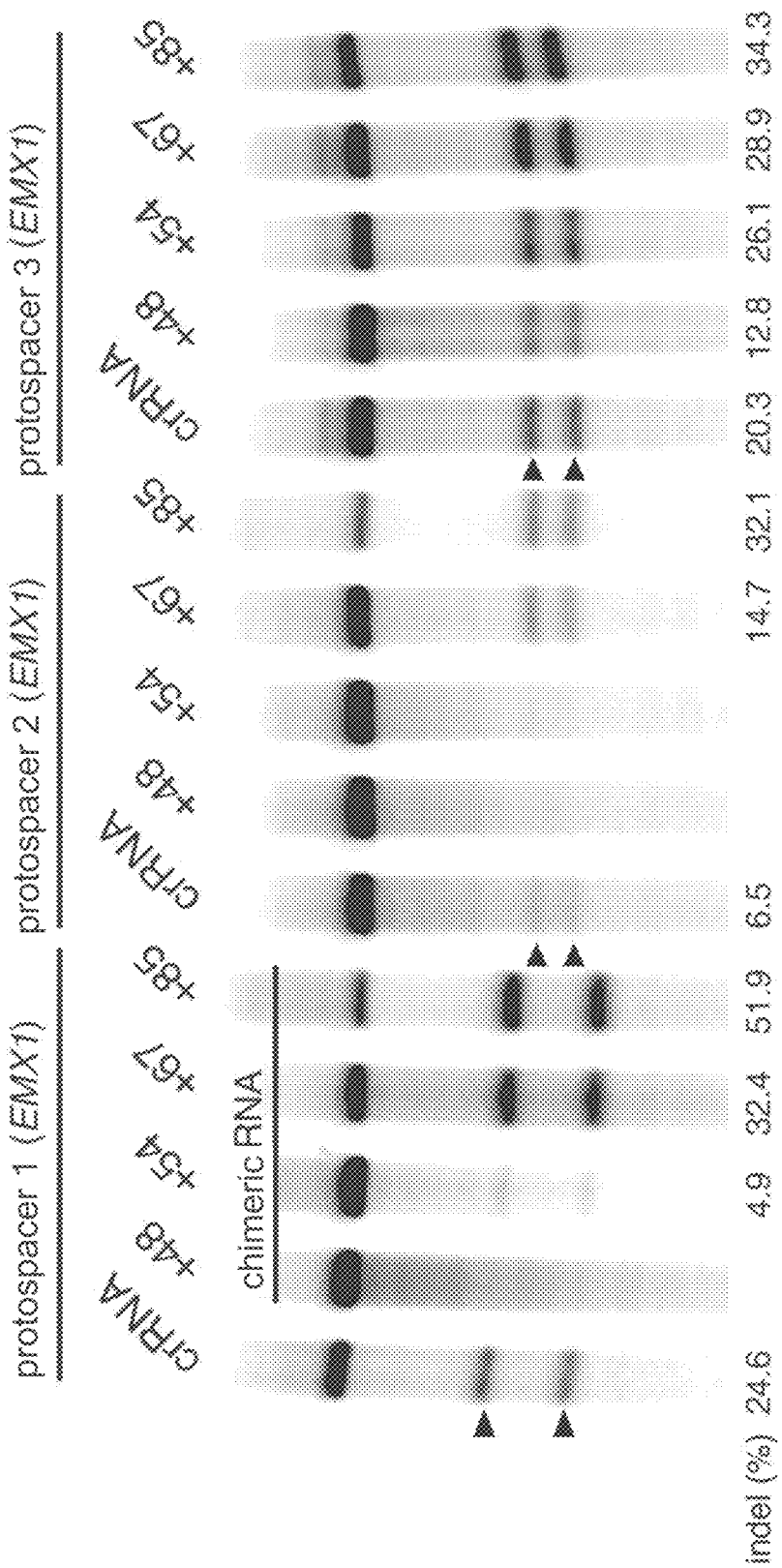
Figure 16C:
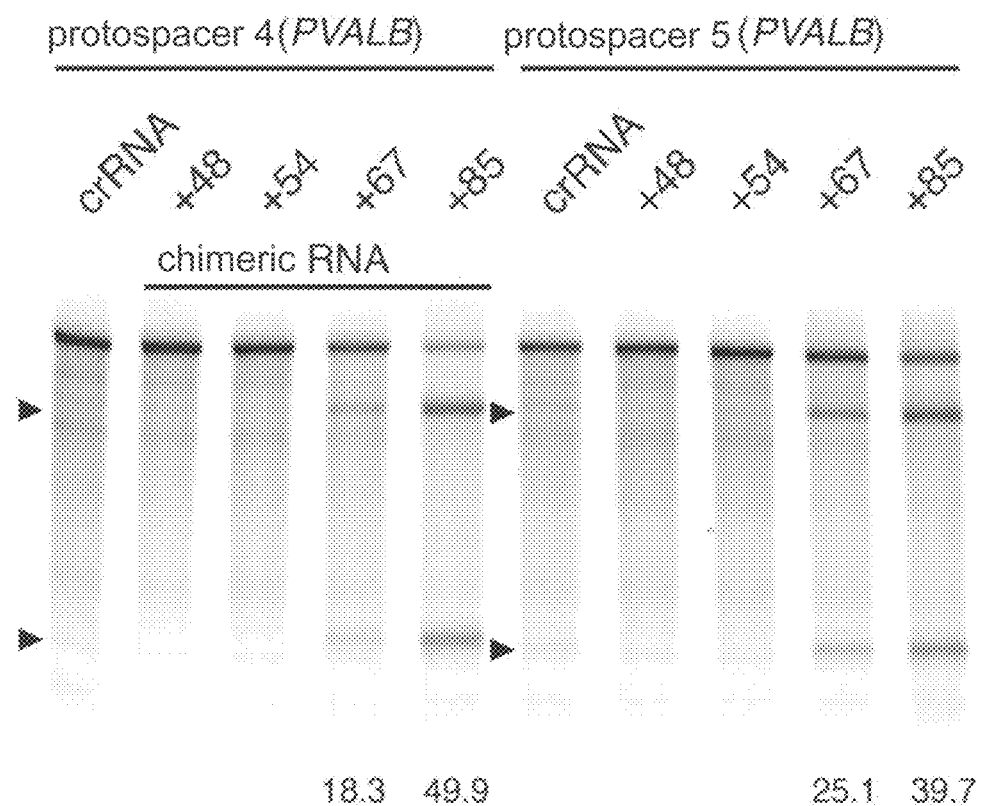

This example describes results obtained for chimeric RNAs (chiRNAs; comprising a guide sequence, a tracr mate sequence, and a tracr sequence in a single transcript) having tracr sequences that incorporate different lengths of wild-type tracrRNA sequence. FIG. 16a illustrates a schematic of a bicistronic expression vector for chimeric RNA and Cas9. Cas9 is driven by the CBh promoter and the chimeric RNA is driven by a U6 promoter. The chimeric guide RNA consists of a 20 bp guide sequence (Ns) joined to the tracr sequence (running from the first "U" of the lower strand to the end of the transcript), which is truncated at various positions as indicated. The guide and tracr sequences are separated by the tracr-mate sequence GUUUUAGAGCUA (SEQ ID NO: 92) followed by the loop sequence GAAA. Results of SURVEYOR assays for Cas9-mediated indels at the human EMX1 and PVALB loci are illustrated in FIGS. 16b and 16c, respectively. Arrows indicate the expected SURVEYOR fragments. ChiRNAs are indicated by their "+n" designation, and crRNA refers to a hybrid RNA where guide and tracr sequences are expressed as separate transcripts. Quantification of these results, performed in triplicate, are illustrated by histogram in FIGS. 17a and 17b, corresponding to FIGS. 16b and 16c, respectively ("N.D." indicates no indels detected). Protospacer IDs and their corresponding genomic target, protospacer sequence, PAM sequence, and strand location are provided in the following Table. Guide sequences were designed to be complementary to the entire protospacer sequence in the case of separate transcripts in the hybrid system, or only to the underlined portion in the case of chimeric RNAs.

TABLE 8

| protospacer ID | genomic target | protospacer sequence (5' to 3') | PAM | SEQ ID NO: | strand |
|---|---|---|---|---|---|
| 1 | EMX1 | GGACATCGATGT CACCTCCAATGA CTAGGG | TGG | 1473 | + |
| 2 | EMX1 | CATTGGAGGTGA CATCGATGTCCT CCCCAT | TGG | 1474 | − |
| 3 | EMX1 | GGAAGGGCCTGA GTCCGAGCAGAA GAAGAA | GGG | 1475 | + |
| 4 | PVALB | GGTGGCGAGAGG GGCCGAGATTGG GTGTTC | AGG | 1476 | + |
| 5 | PVALB | ATGCAGGAGGGT GGCGAGAGGGC CGAGAT | TGG | 1477 | + |

Further details to optimize guide sequences can be found in U.S. application Ser. No. 61/836,127; incorporated herein by reference.

Figure 17B:
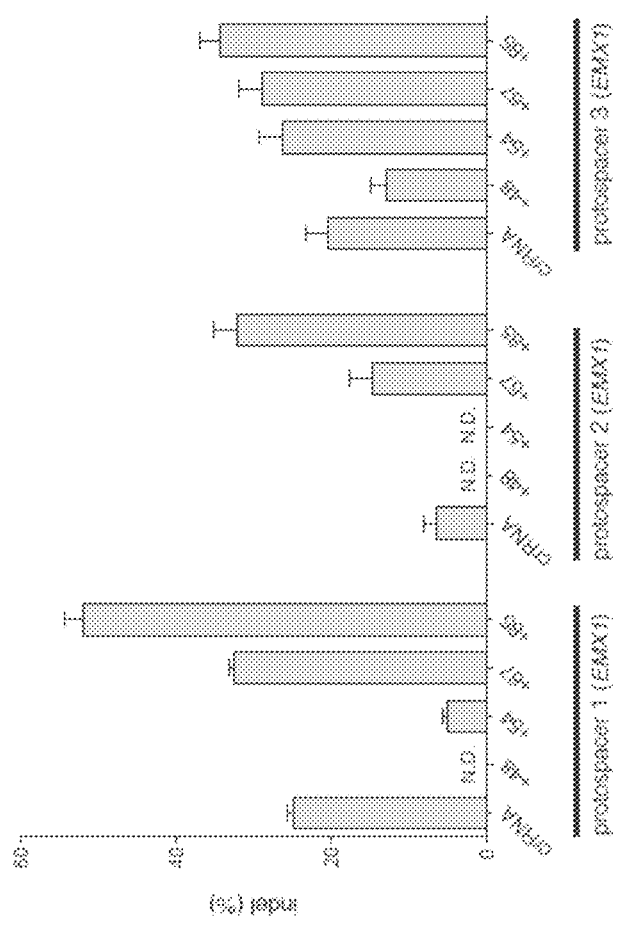
FIG. 17A-B shows a graphical representation of the results of SURVEYOR assays for CRISPR system activity in eukaryotic cells.
Figure 17A:
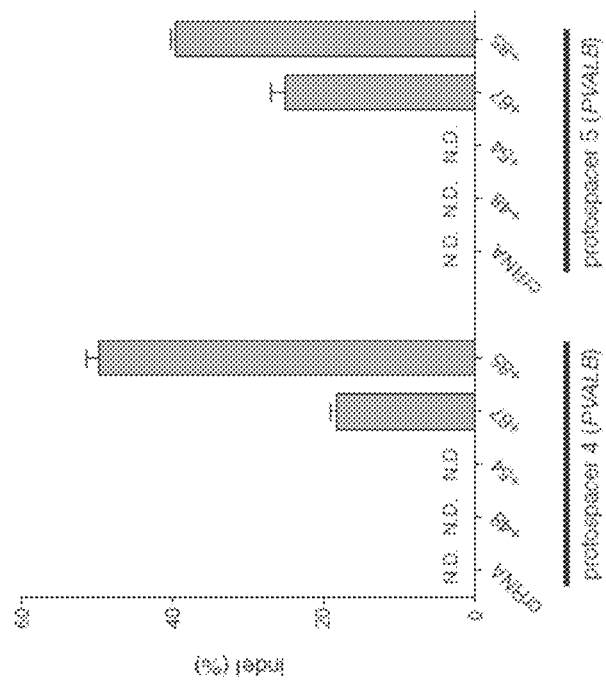

Initially, three sites within the EMX1 locus in human HEK 293FT cells were targeted. Genome modification efficiency of each chiRNA was assessed using the SURVEYOR nuclease assay, which detects mutations resulting from DNA double-strand breaks (DSBs) and their subsequent repair by the non-homologous end joining (NHEJ) DNA damage repair pathway. Constructs designated chiRNA(+n) indicate that up to the +n nucleotide of wild-type tracrRNA is included in the chimeric RNA construct, with values of 48, 54, 67, and 85 used for n. Chimeric RNAs containing longer fragments of wild-type tracrRNA (chiRNA(+67) and chiRNA(+85)) mediated DNA cleavage at all three EMX1 target sites, with chiRNA(+85) in particular demonstrating significantly higher levels of DNA cleavage than the corresponding crRNA/tracrRNA hybrids that expressed guide and tracr sequences in separate transcripts (FIGS. 16b and 17a). Two sites in the PVALB locus that yielded no detectable cleavage using the hybrid system (guide sequence and tracr sequence expressed as separate transcripts) were also targeted using chiRNAs. chiRNA(+67) and chiRNA(+85) were able to mediate significant cleavage at the two PVALB protospacers (FIGS. 16c and 17b).

For all five targets in the EMX1 and PVALB loci, a consistent increase in genome modification efficiency with increasing tracr sequence length was observed. Without wishing to be bound by any theory, the secondary structure formed by the 3' end of the tracrRNA may play a role in enhancing the rate of CRISPR complex formation.

Example 5: Cas9 Diversity

The CRISPR-Cas system is an adaptive immune mechanism against invading exogenous DNA employed by diverse species across bacteria and archaea. The type II CRISPR-Cas9 system consists of a set of genes encoding proteins responsible for the "acquisition" of foreign DNA into the CRISPR locus, as well as a set of genes encoding the "execution" of the DNA cleavage mechanism; these include the DNA nuclease (Cas9), a non-coding transactivating cr-RNA (tracrRNA), and an array of foreign DNA-derived spacers flanked by direct repeats (crRNAs). Upon maturation by Cas9, the tracRNA and crRNA duplex guide the Cas9 nuclease to a target DNA sequence specified by the spacer guide sequences, and mediates double-stranded breaks in the DNA near a short sequence motif in the target DNA that is required for cleavage and specific to each CRISPR-Cas system. The type II CRISPR-Cas systems are found throughout the bacterial kingdom and highly diverse in in Cas9 protein sequence and size, tracrRNA and crRNA direct repeat sequence, genome organization of these elements, and the motif requirement for target cleavage. One species may have multiple distinct CRISPR-Cas systems.

Applicants evaluated 207 putative Cas9s from bacterial species identified based on sequence homology to known Cas9s and structures orthologous to known subdomains, including the HNH endonuclease domain and the RuvC endonuclease domains [information from the Eugene Koonin and Kira Makarova]. Phylogenetic analysis based on the protein sequence conservation of this set revealed five families of Cas9s, including three groups of large Cas9s (~1400 amino acids) and two of small Cas9s (~1100 amino acids) (see FIGS. 19 and 20A-F).

Further details of Cas9s and mutations of the Cas9 enzyme to convert into a nickase or DNA binding protein and use of same with altered functionality can be found in U.S. application Serial Nos 61/836,101 and 61/835,936 incorporated herein by reference.

Example 6: Cas9 Orthologs

Applicants analyzed Cas9 orthologs to identify the relevant PAM sequences and the corresponding chimeric guide RNA. Having an expanded set of PAMs provides broader targeting across the genome and also significantly increases the number of unique target sites and provides potential for identifying novel Cas9s with increased levels of specificity in the genome.

The specificity of Cas9 orthologs can be evaluated by testing the ability of each Cas9 to tolerate mismatches between the guide RNA and its DNA target. For example, the specificity of SpCas9 has been characterized by testing the effect of mutations in the guide RNA on cleavage efficiency. Libraries of guide RNAs were made with single or multiple mismatches between the guide sequence and the target DNA. Based on these findings, target sites for SpCas9 can be selected based on the following guidelines:

To maximize SpCas9 specificity for editing a particular gene, one should choose a target site within the locus of interest such that potential 'off-target' genomic sequences abide by the following four constraints: First and foremost, they should not be followed by a PAM with either 5'-NGG or NAG sequences. Second, their global sequence similarity to the target sequence should be minimized. Third, a maximal number of mismatches should lie within the PAM-proximal region of the off-target site. Finally, a maximal number of mismatches should be consecutive or spaced less than four bases apart.

Similar methods can be used to evaluate the specificity of other Cas9 orthologs and to establish criteria for the selection of specific target sites within the genomes of target species. As mentioned previously phylogenetic analysis based on the protein sequence conservation of this set revealed five families of Cas9s, including three groups of large Cas9s (~1400 amino acids) and two of small Cas9s (~1100 amino acids) (see FIGS. 19 and 20A-F). Further details on Cas orthologs can be found in U.S. application Ser. Nos. 61/836,101 and 61/835,936 incorporated herein by reference.

Example 7: Methodological Improvement to Simplify Cloning and Delivery

Rather than encoding the U6-promoter and guide RNA on a plasmid, Applicants amplified the U6 promoter with a DNA oligo to add on the guide RNA. The resulting PCR product may be transfected into cells to drive expression of the guide RNA.

Example primer pair that allows the generation a PCR product consisting of U6-promoter::guideRNA targeting human Emx1 locus:

```
Forward Primer:
                                       (SEQ ID NO: 1478)
AAACTCTAGAgagggcctatttcccatgattc Reverse Primer (carrying the guide RNA,
which is underlined):
                                       (SEQ ID NO: 1479)
acctctagAAAAAAAGCACCGACTCGGTGCCACTTTTTCAAGTTGATAAC

GGACTAGCCTTATTTTAACTTGCTATGCTGTTTTGTTTCCAAAACAGCAT

AGCTCTAAAACCCCTAGTCATTGGAGGTGACGGTGTTTCGTCCTTTCCAC aag
```

Example 8: Methodological Improvement to Improve Activity

Rather than use pol3 promoters, in particular RNA polymerase III (e.g. U6 or H1 promoters), to express guide RNAs in eukaryotic cells, Applicants express the T7 polymerase in eukaryotic cells to drive expression of guide RNAs using the T7 promoter.

One example of this system may involve introduction of three pieces of DNA:
1. expression vector for Cas9
2. expression vector for T7 polymerase
3. expression vector containing guideRNA fused to the T7 promoter Example 9: Methodological Improvement to Reduce Toxicity of Cas9: Delivery of Cas9 in the Form of mRNA Delivery of Cas9 in the form of mRNA enables transient expression of Cas9 in cells, to reduce toxicity. For example, humanized SpCas9 may be amplified using the following primer pair:

```
Forward Primer (to add on T7 promoter for
in vitro transcription):
                                       (SEQ ID NO: 1480)
TAATACGACTCACTATAGGAAGTGCGCCACCATGGCCCCAAAGAAGAAGC

GG

Reverse Primer (to add on polyA tail):
                                       (SEQ ID NO: 1481)
GGTTTTTTTTTTTTTTTTTTTTTTTTTTTTTTTTtcttaCTTTTTCTTTTT

TGCCTGGCCG
```

Applicants transfect the Cas9 mRNA into cells with either guide RNA in the form of RNA or DNA cassettes to drive guide RNA expression in eukaryotic cells.

Example 10: Methodological Improvement to Reduce Toxicity of Cas9: Use of an Inducible Promoter Applicants transiently turn on Cas9 expression only when it is needed for carrying out genome modification. Examples of inducible system include tetracycline inducible promoters (Tet-On or Tet-Off), small molecule two-hybrid transcription activations systems (FKBP, ABA, etc), or light inducible systems (Phytochrome, LOV domains, or cryptochrome).

Example 11: Improvement of the Cas9 System for In Vivo Application

Figure 23:
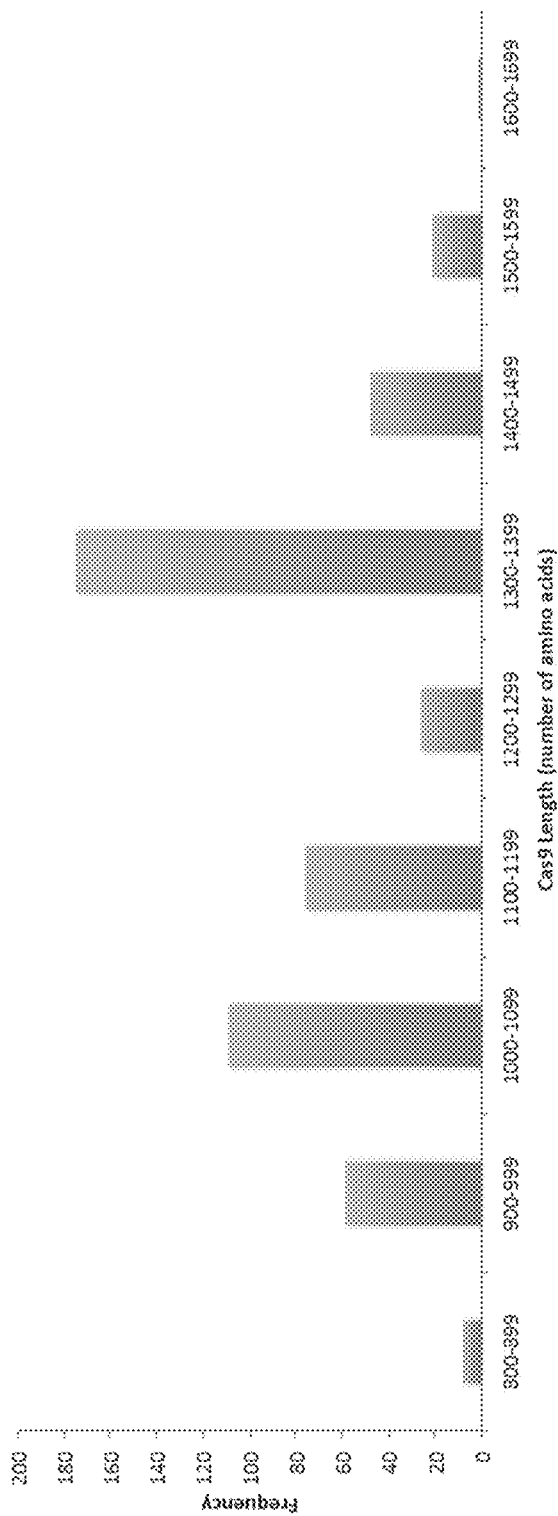
FIG. 23 shows a graph representing the length distribution of Cas9 orthologs.
Figure 24A:
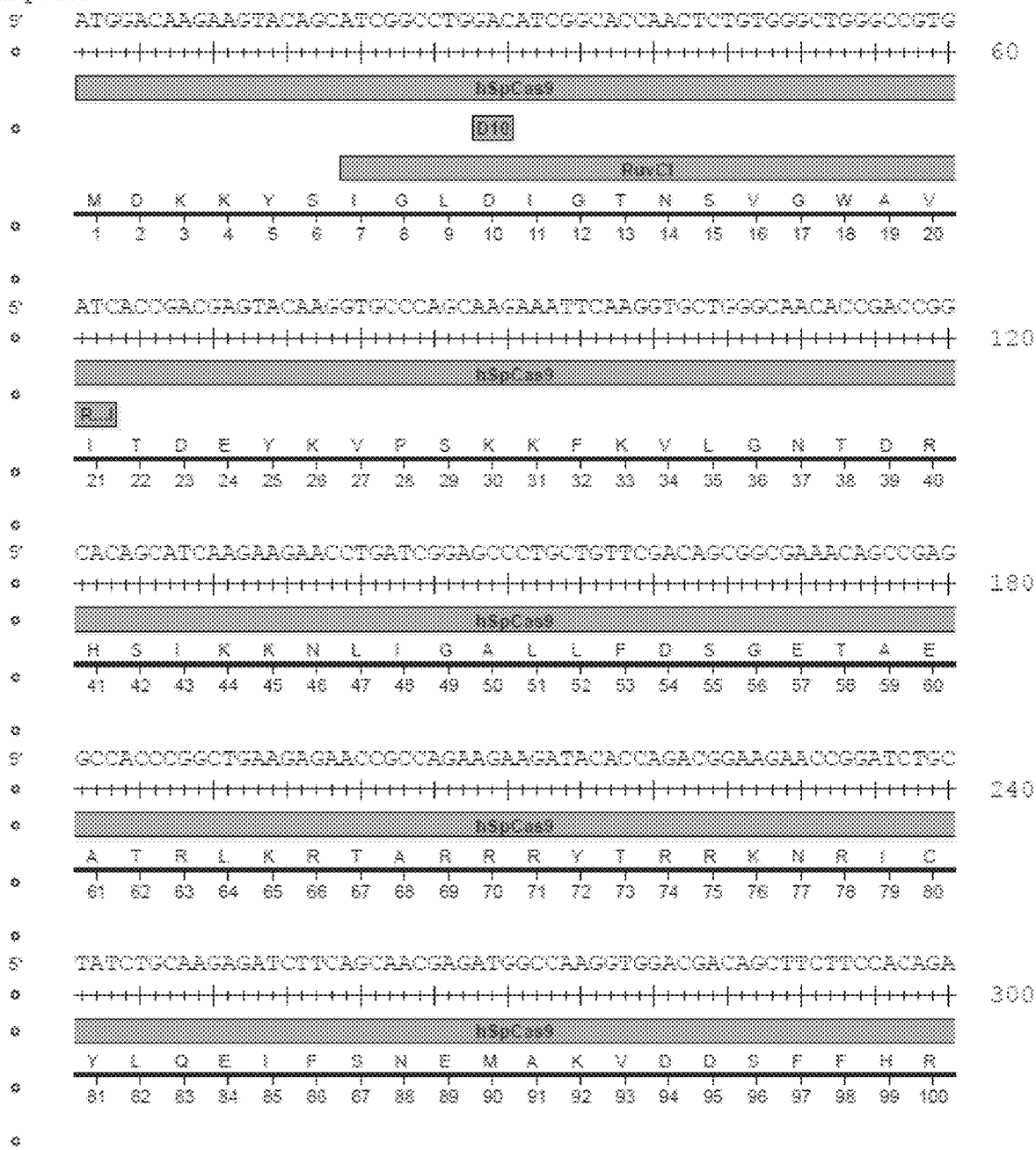
Figure 24M:
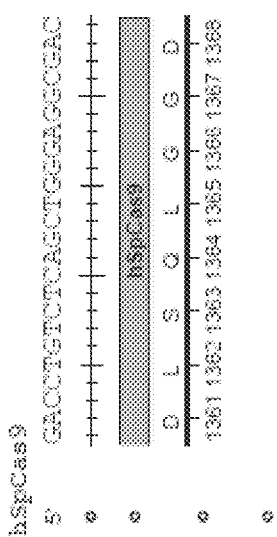

Applicants conducted a Metagenomic search for a Cas9 with small molecular weight. Most Cas9 homologs are fairly large. For example the SpCas9 is around 1368aa long, which is too large to be easily packaged into viral vectors for delivery. A graph representing the length distribution of Cas9 homologs is generated from sequences deposited in GenBank (FIG. 23). Some of the sequences may have been mis-annotated and therefore the exact frequency for each length may not necessarily be accurate. Nevertheless it provides a glimpse at distribution of Cas9 proteins and suggest that there are shorter Cas9 homologs.

Through computational analysis, Applicants found that in the bacterial strain *Campylobacter*, there are two Cas9 proteins with less than 1000 amino acids. The sequence for one Cas9 from *Campylobacter jejuni* is presented below. At this length, CjCas9 can be easily packaged into AAV, lentiviruses, Adenoviruses, and other viral vectors for robust delivery into primary cells and in vivo in animal models. In a preferred embodiment of the invention, the Cas9 protein from *S. aureus* is used.

```
>Campylobacter jejuni Cas9 (CjCas9)
                                        (SEQ ID NO: 1482)
MARILAFDIGISSIGWAFSENDELKDCGVRIFTKVENPKTGESLALPRRL
ARSARKRLARRKARLNHLKHLIANEFKLNYEDYQSFDESLAKAYKGSLIS
PYELRFRALNELLSKQDFARVILHIAKRRGYDDIKNSDDKEKGAILKAIK
QNEEKLANYQSVGEYLYKEYFQKFKENSKEFTNVRNKKESYERCIAQSEL
KDELKLIFKKQREFGESFSKKFEEEVLSVAFYKRALKDFSHLVGNCSFFT
DEKRAPKNSPLAFMEVALTRIINLLNNLKNTEGILYTKDDLNALLNEVLK
NGTLTYKQTKKLLGLSDDYEFKGEKGTYFIEFKKYKEFIKALGEHNLSQD
DLNEIAKDITLIKDEIKLKKALAKYDLNQNQIDSLSKLEFKDHLNISFKA
LKLVTPLMLEGKKYDEACNELNLKVAINEDKKDFLPAFNETYYKDEVTNP
VVLRAIKEYRKVLNALLKKYGKVHKINIELAREVGKNHSQRAKIEKEQNE
NYKAKKDAELECEKLGLKINSKNILKLRLFKEQKEFCAYSGEKIKISDLQ
DEKMLEIDHIYPYSRSFDDSYMNKVLVFTKQNQEKLNQTPFEAFGNDSAK
WQKIEVLAKNLPTKKQKRILDKNYKDKEQKNFKDRNLNDTRYIARLVLNY
TKDYLDFLPLSDDENTKLNDTQKGSKVHVEAKSGMLTSALRHTWGFSAKD
RNNHLHHAIDAVIIAYANNSIVKAFSDFKKEQESNSAELYAKKISELDYK
NKRKFFEPFSGFRQKVLDKIDEIFVSKPERKKPSGALHEETFRKEEEFYQ
SYGGKEGVLKALELGKIRKVNGKIVKNGDMFRVDIFKHKKTNKFYAVPIY
TMDFALKVLPNKAVARSKKGEIKDWILMDENYEFCFSLYKDSLILIQTKD
MQEPEFVYYNAFTSSTVSLIVSKHDNKFETLSKNQKILFKNANEKEVIAK
SIGIQNLKVFEKYIVSALGEVTKAEFRQREDFKK.

The putative tracrRNA element for
this CjCas9 is:
                                        (SEQ ID NO: 1483)
TATAATCTCATAAGAAATTTAAAAAGGGACTAAAATAAAGAGTTTGCGGG
ACTCTGCGGGGTTACAATCCCCTAAAACCGCTTTTAAAATT
The Direct Repeat sequence is:
                                        (SEQ ID NO: 1484)
ATTTTACCATAAAGAAATTTAAAAAGGGACTAAAAC
An example of a chimeric guide RNA for
CjCas9 is:
                                        (SEQ ID NO: 1485)
NNNNNNNNNNNNNNNNNNNNGUUUUAGUCCCGAAAGGGACUAAAAUAAAG
AGUUUGCGGGACUCUGCGGGGUUACAAUCCCCUAAAACCGCUUUU
```

Example 12: Cas9 Optimization

For enhanced function or to develop new functions, Applicants generate chimeric Cas9 proteins by combining fragments from different Cas9 homologs. For example, two example chimeric Cas9 proteins:

For example, Applicants fused the N-term of St1Cas9 (fragment from this protein is in bold) with C-term of SpCas9 (fragment from this protein is underlined).

```
>St1(N)Sp(C)Cas9
                                        (SEQ ID NO: 1486)
MSDLVLGLDIGIGSVGVGILNKVTGEIIHKNSRIFPAAQAENNLVRRTNR
QGRRLARRKKHRRVRLNRLFEESGLITDFTKISINLNPYQLRVKGLTDEL
SNEELFIALKNMVKHRGISYLDDASDDGNSSVGDYAQIVKENSKQLETKT
PGQIQLERYQTYGQLRGDFTVEKDGKKHRLINVFPTSAYRSEALRILQTQ
QEFNPQITDEFINRYLEILTGKRKYYHGPGNEKSRTDYGRYRTSGETLDN
IFGILIGKCTFYPDEFRAAKASYTAQEFNLLNDLNNLTVPTETKKLSKEQ
KNQIINYVKNEKAMGPAKLFKYIAKLLSCDVADIKGYRIDKSGKAEIHTF
EAYRKMKTLETLDIEQMDRETLDKLAYVLTLNTEREGIQEALEHEFADGS
FSQKQVDELVQFRKANSSIFGKGWHNFSVKLMMELIPELYETSEEQMTIL
TRLGKQKTTSSSNKTKYIDEKLLTEEIYNPVVAKSVRQAIKIVNAAIKEY
GDFDNIVIEMARENQTTQKGQKNSRERMKRIEEGIKELGSQILKEHPVEN
TQLQNEKLYLYYLQNGRDMYVDQELDINRLSDYDVDHIVPQSFLKDDSID
NKVLTRSDKNRGKSDNVPSEEVVKKMKNYWRQLLNAKLITQRKEDNLTKA
ERGGLSELDKAGFIKRQLVETRQITKHVAQILDSRMNTKYDENDKLIREV
KVITLKSKLVSDFRKDFQFYKVREINNYHHAHDAYLNAVVGTALIKKYPK
LESEFVYGDYKVYDVRKMIAKSEQEIGKATAKYFFYSNIMNFFKTEITLA
NGEIRKRPLIETNGETGEIVWDKGRDFATVRKVLSMPQVNIVKKTEVQTG
GFSKESILPKRNSDKLIARKKDWDPKKYGGFDSPTVAYSVLVVAKVEKGK
SKKLKSVKELLGITIMERSSFEKNPIDFLEAKGYKEVKKDLIIKLPKYSL
FELENGRKRMLASAGELQKGNELALPSKYVNFLYLASHYEKLKGSPEDNE
QKQLFVEQHKHYLDEIIEQISEFSKRVILADANLDKVLSAYNKHRDKPIR
EQAENIIHLFTLTNLGAPAAFKYFDTTIDRKRYTSTKEVLDATLIHQSIT
GLYETRIDLSQLGGD
>Sp(N)St1(C)Cas9
                                        (SEQ ID NO: 1487)
MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NEKSNEDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLEKTNRKVTVKQLKEDYFKKIECFDSVEISGVEDRFNASLGTYHDLLKI
IKDKDELDNEENEDILEDIVLTLTLFEDREMIEERLKTYAHLFDDKVMKQ
LKRRRYTGWGRLSRKLINGIRDKQSGKTILDFLKSDGEANRNFMQLIHDD
SLTFKEDIQKAQVSGQGDSLHEHIANLAGSPAIKKGILQTVKVVDELVKV
MGRHKPENIVIEMARETNEDDEKKAIQIMKANKDEKDAAMLKAANQYNGK
```

-continued

```
AELPHSVFHGHKQLATKIRLWHQQGERCLYTGKTISIHDLINNSNQFEVD

HILPLSITFDDSLANKVLVYATANQEKGQRTPYQALDSMDDAWSFRELKA

FVRESKTLSNKKKEYLLTEEDISKFDVRKKFIERNLVDTRYASRVVLNAL

QEHFRAHKIDTKVSVVRGQFTSQLRRHWGIEKTRDTYHHHAVDALIIAAS

SQLNLWKKQKNTLVSYSEDQLLDIETGELISDDEYKESVFKAPYQHFVDT

LKSKEFEDSILFSYQVDSKFNRKISDATIYATRQAKVGKDKADETYVLGK

IKDIYTQDGYDAFMMYKKDKSKFLMYRHDPQTFEKVIEPILENYPNKQIN

EKGKEVPCNPFLKYKEEHGYIRKYSKKGNGPEIKSLKYYDSKLGNHIDIT

PKDSNNKVVLQSVSPWRADVYFNKTTGKYEILGLKYADLQFEKGTGTYKI

SQEKYNDIKKKEGVDSDSEFKFTLYKNDLLLVKDTETKEQQLFRFLSRTM

PKQKHYVELKPYDKQKFEGGEALIKVLGNVANSGQCKKGLGKSNISIYKV

RTDVLGNQHIIKNEGDKPKLDF
```

The benefit of making chimeric Cas9 include:
reduce toxicity
improve expression in eukaryotic cells
enhance specificity
reduce molecular weight of protein, make protein smaller by combining the smallest domains from different Cas9 homologs.
Altering the PAM sequence requirement Example 13: Utilization of Cas9 as a Generic DNA Binding Protein Applicants used Cas9 as a generic DNA binding protein by mutating the two catalytic domains (D10 and H840) responsible for cleaving both strands of the DNA target. In order to upregulate gene transcription at a target locus Applicants fused the transcriptional activation domain (VP64) to Cas9. Applicants hypothesized that it would be important to see strong nuclear localization of the Cas9-VP64 fusion protein because transcription factor activation strength is a function of time spent at the target. Therefore, Applicants cloned a set of Cas9-VP64-GFP constructs, transfected them into 293 cells and assessed their localization under a fluorescent microscope 12 hours post-transfection.

The same constructs were cloned as a 2A-GFP rather than a direct fusion in order to functionally test the constructs without a bulky GFP present to interfere. Applicants elected to target the Sox2 locus with the Cas9 transactivator because it could be useful for cellular reprogram and the locus has already been validated as a target for TALE-TF mediated transcriptional activation. For the Sox2 locus Applicants chose eight targets near the transcriptional start site (TSS). Each target was 20 bp long with a neighboring NGG protospacer adjacent motif (PAM). Each Cas9-VP64 construct was co-transfected with each PCR generated chimeric crispr RNA (chiRNA) in 293 cells. 72 hours post transfection the transcriptional activation was assessed using RT-qPCR.

To further optimize the transcriptional activator, Applicants titrated the ratio of chiRNA (Sox2.1 and Sox2.5) to Cas9 (NLS-VP64-NLS-hSpCas9-NLS-VP64-NLS), transfected into 293 cells, and quantified using RT-qPCR. These results indicate that Cas9 can be used as a generic DNA binding domain to upregulate gene transcription at a target locus.

Applicants designed a second generation of constructs.

TABLE 9 pLenti-EF1a-GFP-2A-6xHis-NLS-VP64-NLS-hSpCsn1(D10A, H840A)-NLS ('6xHis' disclosed as SEQ ID NO: 1488)
pLenti-EF1a-GFP-2A-6xHis-NLS-VP64-NLS-hSpCsn1(D10A, H840A) ('6xHis' disclosed as SEQ ID NO: 1488)
pLenti-EF1a-GFP-2A-6xHis-NLS-VP64-NLS-NLS-hSpCsn1(D10A, H840A) ('6xHis' disclosed as SEQ ID NO: 1488)
pLenti-EF1a-GFP-2A-6xHis-NLS-hSpCsn1(D10A, H840A)-NLS ('6xHis' disclosed as SEQ ID NO: 1488)
pLenti-EF1a-GFP-2A-6xHis-NLS-hSpCsn1(D10A, H840A) ('6xHis' disclosed as SEQ ID NO: 1488)
pLenti-EF1a-GFP-2A-6xHis-NLS-NLS-hSpCsn1(D10A, H840A) ('6xHis' disclosed as SEQ ID NO: 1488)

Applicants use these constructs to assess transcriptional activation (VP64 fused constructs) and repression (Cas9 only) by RT-qPCR. Applicants assess the cellular localization of each construct using anti-His antibody, nuclease activity using a Surveyor nuclease assay, and DNA binding affinity using a gel shift assay. In a preferred embodiment of the invention, the gel shift assay is an EMSA gel shift assay.

Example 14: Cas9 Transgenic and Knock in Mice

To generate a mouse that expresses the Cas9 nuclease Applicants submit two general strategies, transgenic and knock in. These strategies may be applied to generate any other model organism of interest, for e.g. Rat. For each of the general strategies Applicants made a constitutively active Cas9 and a Cas9 that is conditionally expressed (Cre recombinase dependent). The constitutively active Cas9 nuclease is expressed in the following context: pCAG-NLS-Cas9-NLS-P2A-EGFP-WPRE-bGHpolyA. pCAG is the promoter, NLS is a nuclear localization signal, P2A is the peptide cleavage sequence, EGFP is enhanced green fluorescent protein, WPRE is the woodchuck hepatitis virus posttranscriptional regulatory element, and bGHpolyA is the bovine growth hormone poly-A signal sequence (FIGS. 25A-B). The conditional version has one additional stop cassette element, loxP-SV40 polyAx3-loxP, after the promoter and before NLS-Cas9-NLS (i.e. pCAG-loxP-SV40polyAx3-loxP-NLS-Cas9-NLS-P2A-EGFP-WPRE-bGHpolyA). The important expression elements can be visualized as in FIG. 26. The constitutive construct should be expressed in all cell types throughout development, whereas, the conditional construct will only allow Cas9 expression when the same cell is expressing the Cre recombinase. This latter version will allow for tissue specific expression of Cas9 when Cre is under the expression of a tissue specific promoter. Moreover, Cas9 expression could be induced in adult mice by putting Cre under the expression of an inducible promoter such as the TET on or off system.

Validation of Cas9 constructs: Each plasmid was functionally validated in three ways: 1) transient transfection in 293 cells followed by confirmation of GFP expression; 2) transient transfection in 293 cells followed by immunofluorescence using an antibody recognizing the P2A sequence; and 3) transient transfection followed by Surveyor nuclease assay. The 293 cells may be 293FT or 293 T cells depending on the cells that are of interest. In a preferred embodiment the cells are 293FT cells. The results of the Surveyor were run out on the top and bottom row of the gel for the conditional and constitutive constructs, respectively. Each was tested in the presence and absence of chimeric RNA targeted to the hEMX1 locus (chimeric RNA hEMX1.1). The results indicate that the construct can successfully target the hEMX1 locus only in the presence of chimeric RNA (and Cre in the conditional case). The gel was quantified and the results are presented as average cutting efficiency and standard deviation for three samples.

Transgenic Cas9 mouse: To generate transgenic mice with constructs, Applicants inject pure, linear DNA into the pronucleus of a zygote from a pseudo pregnant CB56 female. Founders are identified, genotyped, and backcrossed to CB57 mice. The constructs were successfully cloned and verified by Sanger sequencing.

Knock in Cas9 mouse: To generate Cas9 knock in mice Applicants target the same constitutive and conditional constructs to the Rosa26 locus. Applicants did this by cloning each into a Rosa26 targeting vector with the following elements: Rosa26 short homology arm—constitutive/conditional Cas9 expression cassette—pPGK-Neo-Rosa26 long homology arm—pPGK-DTA. pPGK is the promoter for the positive selection marker Neo, which confers resistance to neomycin, a 1 kb short arm, a 4.3 kb long arm, and a negative selection diphtheria toxin (DTA) driven by PGK.

The two constructs were electroporated into R1 mESCs and allowed to grow for 2 days before neomycin selection was applied. Individual colonies that had survived by days 5-7 were picked and grown in individual wells. 5-7 days later the colonies were harvested, half were frozen and the other half were used for genotyping. Genotyping was done by genomic PCR, where one primer annealed within the donor plasmid (AttpF) and the other outside of the short homology arm (Rosa26-R) Of the 22 colonies harvested for the conditional case, 7 were positive (Left). Of the 27 colonies harvested for the constitutive case, zero were positive (Right). It is likely that Cas9 causes some level of toxicity in the mESC and for this reason there were no positive clones. To test this Applicants introduced a Cre expression plasmid into correctly targeted conditional Cas9 cells and found very low toxicity after many days in culture. The reduced copy number of Cas9 in correctly targeted conditional Cas9 cells (1-2 copies per cell) is enough to allow stable expression and relatively no cytotoxicity. Moreover, this data indicates that the Cas9 copy number determines toxicity. After electroporation each cell should get several copies of Cas9 and this is likely why no positive colonies were found in the case of the constitutive Cas9 construct. This provides strong evidence that utilizing a conditional, Cre-dependent strategy should show reduced toxicity. Applicants inject correctly targeted cells into a blastocyst and implant into a female mouse. Chimerics are identified and backcrossed. Founders are identified and genotyped.

Utility of the conditional Cas9 mouse: Applicants have shown in 293 cells that the Cas9 conditional expression construct can be activated by co-expression with Cre. Applicants also show that the correctly targeted R1 mESCs can have active Cas9 when Cre is expressed. Because Cas9 is followed by the P2A peptide cleavage sequence and then EGFP Applicants identify successful expression by observing EGFP. This same concept is what makes the conditional Cas9 mouse so useful. Applicants may cross their conditional Cas9 mouse with a mouse that ubiquitously expresses Cre (ACTB-Cre line) and may arrive at a mouse that expresses Cas9 in every cell. It should only take the delivery of chimeric RNA to induce genome editing in embryonic or adult mice. Interestingly, if the conditional Cas9 mouse is crossed with a mouse expressing Cre under a tissue specific promoter, there should only be Cas9 in the tissues that also express Cre. This approach may be used to edit the genome in only precise tissues by delivering chimeric RNA to the same tissue.

Example 15: Cas9 Diversity and Chimeric RNAs

The CRISPR-Cas system is an adaptive immune mechanism against invading exogenous DNA employed by diverse species across bacteria and archaea. The type II CRISPR-Cas system consists of a set of genes encoding proteins responsible for the "acquisition" of foreign DNA into the CRISPR locus, as well as a set of genes encoding the "execution" of the DNA cleavage mechanism; these include the DNA nuclease (Cas9), a non-coding transactivating cr-RNA (tracrRNA), and an array of foreign DNA-derived spacers flanked by direct repeats (crRNAs). Upon maturation by Cas9, the tracrRNA and crRNA duplex guide the Cas9 nuclease to a target DNA sequence specified by the spacer guide sequences, and mediates double-stranded breaks in the DNA near a short sequence motif in the target DNA that is required for cleavage and specific to each CRISPR-Cas system. The type II CRISPR-Cas systems are found throughout the bacterial kingdom and highly diverse in in Cas9 protein sequence and size, tracrRNA and crRNA direct repeat sequence, genome organization of these elements, and the motif requirement for target cleavage. One species may have multiple distinct CRISPR-Cas systems.

Applicants evaluated 207 putative Cas9s from bacterial species identified based on sequence homology to known Cas9s and structures orthologous to known subdomains, including the HNH endonuclease domain and the RuvC endonuclease domains [information from the Eugene Koonin and Kira Makarova]. Phylogenetic analysis based on the protein sequence conservation of this set revealed five families of Cas9s, including three groups of large Cas9s (~1400 amino acids) and two of small Cas9s (~1100 amino acids) (FIGS. 19A-D and 20A-F).

Applicants have also optimized Cas9 guide RNA using in vitro methods.

Example 16: Cas9 Mutations

In this example, Applicants show that the following mutations can convert SpCas9 into a nicking enzyme: D10A, E762A, H840A, N854A, N863A, D986A.

Applicants provide sequences showing where the mutation points are located within the SpCas9 gene (FIG. 24A-M). Applicants also show that the nickases are still able to mediate homologous recombination. Furthermore, Applicants show that SpCas9 with these mutations (individually) do not induce double strand break.

Cas9 orthologs all share the general organization of 3-4 RuvC domains and a HNH domain. The 5' most RuvC domain cleaves the non-complementary strand, and the HNH domain cleaves the complementary strand. All notations are in reference to the guide sequence.

The catalytic residue in the 5' RuvC domain is identified through homology comparison of the Cas9 of interest with other Cas9 orthologs (from *S. pyogenes* type II CRISPR locus, *S. thermophilus* CRISPR locus 1, *S. thermophilus* CRISPR locus 3, and Franciscilla *novicida* type II CRISPR locus), and the conserved Asp residue is mutated to alanine to convert Cas9 into a complementary-strand nicking enzyme. Similarly, the conserved His and Asn residues in the HNH domains are mutated to Alanine to convert Cas9 into a non-complementary-strand nicking enzyme.

Example 17: Cas9 Transcriptional Activation and Cas9 Repressor

Cas9 Transcriptional Activation

A second generation of constructs were designed and tested (Table 10). These constructs are used to assess transcriptional activation (VP64 fused constructs) and repression (Cas9 only) by RT-qPCR. Applicants assess the cellular localization of each construct using anti-His antibody, nuclease activity using a Surveyor nuclease assay, and DNA binding affinity using a gel shift assay.

Cas Repressor

It has been shown previously that dCas9 can be used as a generic DNA binding domain to repress gene expression. Applicants report an improved dCas9 design as well as dCas9 fusions to the repressor domains KRAB and SID4x. From the plasmid library created for modulating transcription using Cas9 in the following Table, the following repressor plasmids were functionally characterized by qPCR: pXRP27, pXRP28, pXRP29, pXRP48, pXRP49, pXRP50, pXRP51, pXRP52, pXRP53, pXRP56, pXRP58, pXRP59, pXRP61, and pXRP62.

Each dCas9 repressor plasmid was co-transfected with two guide RNAs targeted to the coding strand of the beta-catenin gene. RNA was isolated 72 hours after transfection and gene expression was quantified by RT-qPCR. The endogenous control gene was GAPDH. Two validated shRNAs were used as positive controls. Negative controls were certain plasmids transfected without gRNA, these are denoted as "pXRP ## control". The plasmids pXRP28, pXRP29, pXRP48, and pXRP49 could repress the beta-catenin gene when using the specified targeting strategy. These plasmids correspond to dCas9 without a functional domain (pXRP28 and pXRP28) and dCas9 fused to SID4× (pXRP48 and pXRP49).

Further work investigates: repeating the above experiment, targeting different genes, utilizing other gRNAs to determine the optimal targeting position, and multiplexed repression. (Table discloses 'GGGGS3' as SEQ ID NO: 1747, 'EAAAK3' as SEQ ID NO: 1748 and 'GGGGGS3' as SEQ ID NO: 1749)

TABLE 10 pXRP024-pLenti2-EF1a-VP64-NLS-FLAG-Linker-dCas9-NLS-gLuc-2A-GFP-WPRE pXRP025-pLenti2-EF1a-VP64-NLS-GGGGS₃Linker-dCas9-NLS-gLuc-2A-GFP-WPRE pXRP026-pLenti2-EF1a-VP64-NLS-EAAAK₃Linker-dCas9-NLS-gLuc-2A-GFP-WPRE pXRP027-pLenti2-EF1a-NLS-FLAG-Linker-dCas9-NLS-gLuc-2A-GFP-WPRE pXRP028-pLenti2-EF1a-NLS-GGGGS₃Linker-dCas9-NLS-gLuc-2A-GFP-WPRE pXRP029-pLenti2-EF1a-NLS-EAAAK₃Linker-dCas9-NLS-gLuc-2A-GFP-WPRE pXRP030-pLenti2-pSV40-VP64-NLS-FLAG-Linker-dCas9-NLS-gLuc-2A-GFP-WPRE pXRP031-pLenti2-pPGK-VP64-NLS-FLAG-Linker-dCas9-NLS-gLuc-2A-GFP-WPRE pXRP032-pLenti2-LTR-VP64-NLS-FLAG-Linker-dCas9-NLS-gLuc-2A-GFP-WPRE pXRP033-pLenti2-pSV40-VP64-NLS-GGGGS₃Linker-dCas9-NLS-gLuc-2A-GFP-WPRE pXRP034-pLenti2-pPGK-VP64-NLS-GGGGS₃Linker-dCas9-NLS-gLuc-2A-GFP-WPRE pXRP035-pLenti2-LTR-VP64-NLS-GGGGS₃Linker-dCas9-NLS-gLuc-2A-GFP-WPRE pXRP036-pLenti2-pSV40-VP64-NLS-EAAAK₃Linker-dCas9-NLS-gLuc-2A-GFP-WPRE pXRP037-pLenti2-pPGK-VP64-NLS-EAAAK₃Linker-dCas9-NLS-gLuc-2A-GFP-WPRE pXRP038-pLenti2-LTR-VP64-NLS-EAAAK₃Linker-dCas9-NLS-gLuc-2A-GFP-WPRE pXRP048-pLenti2-EF1a-SID4x-NLS-FLAG-Linker-dCas9-NLS-gLuc-2A-GFP-WPRE pXRP049-pLenti2-EF1a-SID4X-NLS-GGGGS₃Linker-dCas9-NLS-gLuc-2A-GFP-WPRE pXRP050-pLenti2-EF1a-SID4X-NLS-EAAAK₃Linker-dCas9-NLS-gLuc-2A-GFP-WPRE pXRP051-pLenti2-EF1a-KRAB-NLS-FLAG-Linker-dCas9-NLS-gLuc-2A-GFP-WPRE pXRP052-pLenti2-EF1a-KRAB-NLS-GGGGS₃Linker-dCas9-NLS-gLuc-2A-GFP-WPRE pXRP053-pLenti2-EF1a-KRAB-NLS-EAAAK₃Linker-dCas9-NLS-gLuc-2A-GFP-WPRE pXRP054-pLenti2-EF1a-dCas9-Linker-FLAG-NLS-VP64-gLuc-2A-GFP-WPRE pXRP055-pLenti2-EF1a-dCas9-Linker-FLAG-NLS-SID4X-gLuc-2A-GFP-WPRE pXRP056-pLenti2-EF1a-dCas9-Linker-FLAG-NLS-KRAB-gLuc-2A-GFP-WPRE pXRP057-pLenti2-EF1a-dCas9-GGGGGS₃-NLS-VP64-gLuc-2A-GFP-WPRE pXRP058-pLenti2-EF1a-dCas9-GGGGGS₃-NLS-SID4X-gLuc-2A-GFP-WPRE pXRP059-pLenti2-EF1a-dCas9-GGGGGS₃-NLS-KRAB-gLuc-2A-GFP-WPRE TABLE 10-continued pXRP060-pLenti2-EF1a-dCas9-EAAAK$_3$-NLS-VP64-gLuc-2A-GFP-WPRE pXRP061-pLenti2-EF1a-dCas9-EAAAK$_3$-NLS-SID4X-gLuc-2A-GFP-WPRE pXRP062-pLenti2-EF1a-dCas9-EAAAK$_3$-NLS-KRAB-gLuc-2A-GFP-WPRE pXRP024-pLenti2-EF1a-VP64-NLS-FLAG-Linker-Cas9-NLS-gLuc-2A-GFP-WPRE pXRP025-pLenti2-EF1a-VP64-NLS-GGGGS$_3$Linker-Cas9-NLS-gLuc-2A-GFP-WPRE pXRP026-pLenti2-EF1a-VP64-NLS-EAAAK$_3$Linker-Cas9-NLS-gLuc-2A-GFP-WPRE pXRP027-pLenti2-EF1a-NLS-FLAG-Linker-Cas9-NLS-gLuc-2A-GFP-WPRE pXRP028-pLenti2-EF1a-NLS-GGGGS$_3$Linker-Cas9-NLS-gLuc-2A-GFP-WPRE pXRP029-pLenti2-EF1a-NLS-EAAAK$_3$Linker-Cas9-NLS-gLuc-2A-GFP-WPRE pXRP030-pLenti2-pSV40-VP64-NLS-FLAG-Linker-Cas9-NLS-gLuc-2A-GFP-WPRE pXRP031-pLenti2-pPGK-VP64-NLS-FLAG-Linker-Cas9-NLS-gLuc-2A-GFP-WPRE pXRP032-pLenti2-LTR-VP64-NLS-FLAG-Linker-Cas9-NLS-gLuc-2A-GFP-WPRE pXRP033-pLenti2-pSV40-VP64-NLS-GGGGS$_3$Linker-Cas9-NLS-gLuc-2A-GFP-WPRE pXRP034-pLenti2-pPGK-VP64-NLS-GGGGS$_3$Linker-Cas9-NLS-gLuc-2A-GFP-WPRE pXRP035-pLenti2-LTR-VP64-NLS-GGGGS$_3$Linker-Cas9-NLS-gLuc-2A-GFP-WPRE pXRP036-pLenti2-pSV40-VP64-NLS-EAAAK$_3$Linker-Cas9-NLS-gLuc-2A-GFP-WPRE pXRP037-pLenti2-pPGK-VP64-NLS-EAAAK$_3$Linker-Cas9-NLS-gLuc-2A-GFP-WPRE pXRP038-pLenti2-LTR-VP64-NLS-EAAAK$_3$Linker-Cas9-NLS-gLuc-2A-GFP-WPRE pXRP048-pLenti2-EF1a-SID4x-NLS-FLAG-Linker-Cas9-NLS-gLuc-2A-GFP-WPRE pXRP049-pLenti2-EF1a-SID4X-NLS-GGGGS$_3$Linker-Cas9-NLS-gLuc-2A-GFP-WPRE pXRP050-pLenti2-EF1a-SID4X-NLS-EAAAK$_3$Linker-Cas9-NLS-gLuc-2A-GFP-WPRE pXRP051-pLenti2-EF1a-KRAB-NLS-FLAG-Linker-Cas9-NLS-gLuc-2A-GFP-WPRE pXRP052-pLenti2-EF1a-KRAB-NLS-GGGGS$_3$Linker-Cas9-NLS-gLuc-2A-GFP-WPRE pXRP053-pLenti2-EF1a-KRAB-NLS-EAAAK$_3$Linker-Cas9-NLS-gLuc-2A-GFP-WPRE pXRP054-pLenti2-EF1a-Cas9-Linker-FLAG-NLS-VP64-gLuc-2A-GFP-WPRE pXRP055-pLenti2-EF1a-Cas9-Linker-FLAG-NLS-SID4X-gLuc-2A-GFP-WPRE pXRP056-pLenti2-EF1a-Cas9-Linker-FLAG-NLS-KRAB-gLuc-2A-GFP-WPRE pXRP057-pLenti2-EF1a-Cas9-GGGGGS$_3$-NLS-VP64-gLuc-2A-GFP-WPRE pXRP058-pLenti2-EF1a-Cas9-GGGGGS$_3$-NLS-SID4X-gLuc-2A-GFP-WPRE pXRP059-pLenti2-EF1a-Cas9-GGGGGS$_3$-NLS-KRAB-gLuc-2A-GFP-WPRE pXRP060-pLenti2-EF1a-Cas9-EAAAK$_3$-NLS-VP64-gLuc-2A-GFP-WPRE pXRP061-pLenti2-EF1a-Cas9-EAAAK$_3$-NLS-SID4X-gLuc-2A-GFP-WPRE pXRP062-pLenti2-EF1a-Cas9-EAAAK$_3$-NLS-KRAB-gLuc-2A-GFP-WPRE Example 18: Targeted Deletion of Genes Involved in Cholesterol Biosynthesis, Fatty Acid Biosynthesis, and Other Metabolic Disorders, Genes Encoding Mis-Folded Proteins Involved in Amyloid and Other Diseases, Oncogenes Leading to Cellular Transformation, Latent Viral Genes, and Genes Leading to Dominant-Negative Disorders, Amongst Other Disorders Applicants demonstrate gene delivery of a CRISPR-Cas system in the liver, brain, ocular, epithelial, hematopoetic, or another tissue of a subject or a patient in need thereof, suffering from metabolic disorders, amyloidosis and protein-aggregation related diseases, cellular transformation arising from genetic mutations and translocations, dominant negative effects of gene mutations, latent viral infections, and other related symptoms, using either viral or nanoparticle delivery system.

Study Design: Subjects or patients in need thereof suffering from metabolic disorders, amyloidosis and protein aggregation related disease which include but are not limited to human, non-primate human, canine, feline, bovine, equine, other domestic animals and related mammals. The CRISPR-Cas system is guided by a chimeric guide RNA and targets a specific site of the human genomic loci to be cleaved. After cleavage and non-homologous end-joining mediated repair, frame-shift mutation results in knock out of genes.

Applicants select guide-RNAs targeting genes involved in above-mentioned disorders to be specific to endogenous loci with minimal off-target activity. Two or more guide RNAs may be encoded into a single CRISPR array to induce simultaneous double-stranded breaks in DNA leading to micro-deletions of affected genes or chromosomal regions.

Identification and Design of Gene Targets

For each candidate disease gene, Applicants select DNA sequences of interest include protein-coding exons, sequences including and flanking known dominant negative mutation sites, sequences including and flanking pathological repetitive sequences. For gene-knockout approaches, early coding exons closest to the start codon offer best options for achieving complete knockout and minimize possibility of truncated protein products retaining partial function.

Applicants analyze sequences of interest for all possible targetable 20-bp sequences immediately 5' to a NGG motif (for SpCas9 system) or a NNAGAAW (for St1Cas9 system). Applicants choose sequences for unique, single RNA-guided Cas9 recognition in the genome to minimize off-target effects based on computational algorithm to determine specificity.

Cloning of Guide Sequences into a Delivery System

Guide sequences are synthesized as double-stranded 20-24 bp oligonucleotides. After 5'-phosphorylation treatment of oligos and annealing to form duplexes, oligos are ligated into suitable vector depending on the delivery method:

Virus-Based Delivery Methods

AAV-based vectors (PX260, 330, 334, 335) have been described elsewhere

Lentiviral-based vectors use a similar cloning strategy of directly ligating guide sequences into a single vector carrying a U6 promoter-driven chimeric RNA scaffold and a EF1a promoter-driven Cas9 or Cas9 nickase.

Virus production is described elsewhere.

Nanoparticle-Based RNA Delivery Methods

1. Guide sequences are synthesized as an oligonucleotide duplex encoding T7 promoter-guide sequence-chimeric RNA. A T7 promoter is added 5' of Cas9 by PCR method.
2. T7-driven Cas9 and guide-chimeric RNAs are transcribed in vitro, and Cas9 mRNA is further capped and A-tailed using commercial kits. RNA products are purified per kit instructions.

Hydrodynamic Tail Vein Delivery Methods (for Mouse)

Guide sequences are cloned into AAV plasmids as described above and elsewhere in this application.

In vitro validation on cell lines

Transfection

1. DNA Plasmid Transfection

Plasmids carrying guide sequences are transfected into human embryonic kidney (HEK293T) or human embryonic stem (hES) cells, other relevant cell types using lipid-, chemical-, or electroporation-based methods. For a 24-well transfection of HEK293T cells (~260,000 cells), 500 ng of total DNA is transfected into each single well using Lipofectamine 2000. For a 12-well transfection of hES cells, 1 ug of total DNA is transfected into a single well using Fugene HD.

2. RNA Transfection

Purified RNA described above is used for transfection into HEK293T cells. 1-2 ug of RNA may be transfected into ~260,000 using Lipofectamine 2000 per manufacturer's instruction. RNA delivery of Cas9 and chimeric RNA is shown in FIG. 28.

Assay of Indel Formation In Vitro

Cells are harvested 72-hours post-transfection and assayed for indel formation as an indication of double-stranded breaks.

Briefly, genomic region around target sequence is PCR amplified (~400-600 bp amplicon size) using high-fidelity polymerase. Products are purified, normalized to equal concentration, and slowly annealed from 95° C. to 4° C. to allow formation of DNA heteroduplexes. Post annealing, the Cel-I enzyme is used to cleave heteroduplexes, and resulting products are separated on a polyacrylamide gel and indel efficiency calculated.

In vivo proof of principle in animal

Delivery Mechanisms

AAV or Lentivirus production is described elsewhere.

Nanoparticle formulation: RNA mixed into nanoparticle formulation

Hydrodynamic tail vein injections with DNA plasmids in mice are conducted using a commercial kit Cas9 and guide sequences are delivered as virus, nanoparticle-coated RNA mixture, or DNA plasmids, and injected into subject animals. A parallel set of control animals is injected with sterile saline, Cas9 and GFP, or guide sequence and GFP alone.

Three weeks after injection, animals are tested for amelioration of symptoms and sacrificed. Relevant organ systems analyzed for indel formation. Phenotypic assays include blood levels of HDL, LDL, lipids, Assay for Indel Formation DNA is extracted from tissue using commercial kits; indel assay will be performed as described for in vitro demonstration.

Therapeutic applications of the CRISPR-Cas system are amenable for achieving tissue-specific and temporally controlled targeted deletion of candidate disease genes. Examples include genes involved in cholesterol and fatty acid metabolism, amyloid diseases, dominant negative diseases, latent viral infections, among other disorders.

Examples of a single guide-RNA to introduce targeted indels at a gene locus

| Disease | GENE | SPACER | PAM | SEQ ID NO: | Mechanism | References |
|---|---|---|---|---|---|---|
| Hyper-cholesterol-emia | HMGCR | GCCAA ATTGG ACGAC CCTCG | CGG | 1489 | Knockout | Fluvastatin: a review of its pharmacology and use in the management of hypercholesterolaemia. (Plosker GL et al. Drugs 1996, 51(3):433-459) |
| Hyper-cholesterol-emia | SQLE | CGAGG AGACC CCCGT TTCGG | TGG | 1490 | Knockout | Potential role of non-statin cholesterol lowering agents (Trapani et al. IUBMB Life, Volume 63, Issue 11, pages 964-971, November 2011) |
| Hyper-lipidemia | DGAT1 | CCCGC CGCCG CCGTG GCTCG | AGG | 1491 | Knockout | DGAT1 inhibitors as anti-obesity and anti-diabetic agents. (Birch AM et al. Current Opinion in Drug Discovery & Development [2010, 13(4):489-496) |
| Leukemia | BCRABL | TGAGC TCTAC GAGAT CCACA | AGG | 1492 | Knockout | Killing of leukemic cells with a BCR/ABL fusion gene by RNA interference (RNAi). (Fuchs et al. Oncogene 2002, 21(37):5716-5724) |

Examples of a Pair of Guide-RNA to Introduce Chromosomal Microdeletion at a Gene Locus

| Disease | GENE | SPACER | PAM | SEQ ID NO: | Mechanism | References |
|---|---|---|---|---|---|---|
| Hyper-lipidemia | PLIN2 guide1 | CTCAA AATTC ATACC GGTTG | TGG | 1493 | Micro-deletion | Perilipin-2 Null Mice are Protected Against Diet-Induced Obesity, Adipose Inflammation and Fatty Liver Disease (McManaman JL et al. The Journal of Lipid Research, jlr.M035063. First Published on Feb. 12, 2013) |
| Hyper-lipidemia | PLIN2 guide2 | CGTTA AACAA CAACC GGACT | TGG | 1494 | Micro-deletion | |
| Hyper-lipidemia | SREBP guide1 | TTCAC CCCGC GGCGC TGAAT | ggg | 1495 | Micro-deletion | Inhibition of SREBP by a Small Molecule, Betulin, Improves Hyperlipidemia and Insulin Resistance and Reduces Atherosclerotic Plaques (Tang J et al. Cell Metabolism, Volume 13, Issue 1, 44-56, 5 January 2011) |
| Hyper-lipidemia | SREBP guide2 | ACCAC TACCA GTCCG TCCAC | agg | 1496 | Micro-deletion | |

Example 19: Targeted Correction of deltaF508 or Other Mutations in Cystic Fibrosis Using AAV An aspect of the invention provides for a pharmaceutical composition that may comprise an CRISPR-Cas gene therapy particle and a biocompatible pharmaceutical carrier. According to another aspect, a method of gene therapy for the treatment of a subject having a mutation in the CFTR gene comprises administering a therapeutically effective amount of a CRISPR-Cas gene therapy particle to the cells of a subject.

This Example demonstrates gene transfer or gene delivery of a CRISPR-Cas system in airways of subject or a patient in need thereof, suffering from cystic fibrosis or from cystic fibrosis related symptoms, using adeno-associated virus (AAV) particles.

Study Design: Subjects or patients in need there of: Human, non-primate human, canine, feline, bovine, equine and other domestic animals, related. This study tests efficacy of gene transfer of a CRISPR-Cas system by a AAV vector. Applicants determine transgene levels sufficient for gene expression and utilize a CRISPR-Cas system comprising a Cas9 enzyme to target deltaF508 or other CFTR-inducing mutations.

The treated subjects receive pharmaceutically effective amount of aerosolized AAV vector system per lung endo-bronchially delivered while spontaneously breathing. The control subjects receive equivalent amount of a pseudotyped AAV vector system with an internal control gene. The vector system may be delivered along with a pharmaceutically acceptable or biocompatible pharmaceutical carrier. Three weeks or an appropriate time interval following vector administration, treated subjects are tested for amelioration of cystic fibrosis related symptoms.

Applicants Use an Adenovirus or an AAV Particle.

Applicants clone the following gene constructs, each operably linked to one or more regulatory sequences (Cbh or EF1α promoter for Cas9, U6 or H1 promoter for chimeric guide RNA), into one or more adenovirus or AAV vectors or any other compatible vector: A CFTRdelta508 targeting chimeric guide RNA (FIG. 31B), a repair template for deltaF508 mutation (FIG. 31C) and a codon optimized Cas9 enzyme with optionally one or more nuclear localization signal or sequence(s) (NLS(s)), e.g., two (2) NLSs.

Identification of Cas9 Target Site

Figure 31A:
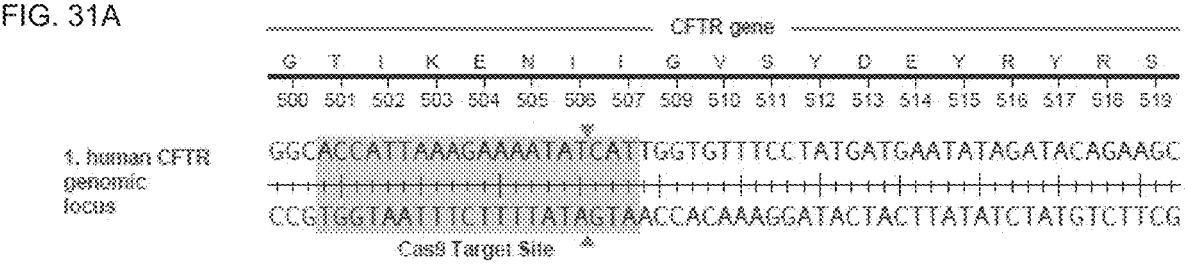
FIG. 31A-C shows the repair strategy for Cystic Fibrosis delta F508 mutation.
Figure 31B:
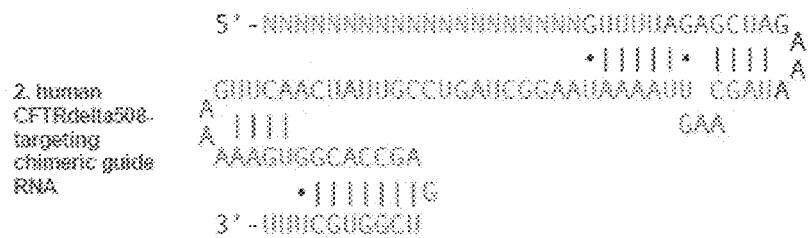
Figure 31C:
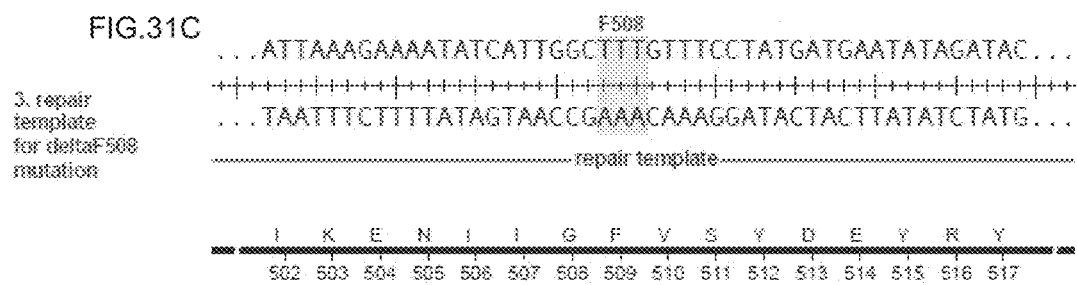

Applicants analyzed the human CFTR genomic locus and identified the Cas9 target site (FIG. 31A). (PAM may contain a NGG or a NNAGAAW motif).

Gene Repair Strategy

Applicants introduce an adenovirus/AAV vector system comprising a Cas9 (or Cas9 nickase) and the guide RNA along with a adenovirus/AAV vector system comprising the homology repair template containing the F508 residue into the subject via one of the methods of delivery discussed earlier. The CRISPR-Cas system is guided by the CFTRdelta 508 chimeric guide RNA and targets a specific site of the CFTR genomic locus to be nicked or cleaved. After cleavage, the repair template is inserted into the cleavage site via homologous recombination correcting the deletion that results in cystic fibrosis or causes cystic fibrosis related symptoms. This strategy to direct delivery and provide systemic introduction of CRISPR systems with appropriate guide RNAs can be employed to target genetic mutations to edit or otherwise manipulate genes that cause metabolic, liver, kidney and protein diseases and other disorders.

Example 20: Delivery of CRISPR System

Cas9 and its chimeric guide RNA, or combination of tracrRNA and crRNA, can be delivered either as DNA or RNA. Delivery of Cas9 and guide RNA both as RNA (normal or containing base or backbone modifications) molecules can be used to reduce the amount of time that Cas9 protein persist in the cell. This may reduce the level of off-target cleavage activity in the target cell. Since delivery of Cas9 as mRNA takes time to be translated into protein, it might be advantageous to deliver the guide RNA several hours following the delivery of Cas9 mRNA, to maximize the level of guide RNA available for interaction with Cas9 protein.

In situations where guide RNA amount is limiting, it may be desirable to introduce Cas9 as mRNA and guide RNA in the form of a DNA expression cassette with a promoter driving the expression of the guide RNA. This way the amount of guide RNA available will be amplified via transcription.

A variety of delivery systems can be introduced to introduce Cas9 (DNA or RNA) and guide RNA (DNA or RNA) into the host cell. These include the use of liposomes, viral vectors, electroporation, nanoparticles, nanowires (Shalek et al., Nano Letters, 2012), exosomes. Molecular trojan horses liposomes (Pardridge et al., Cold Spring Harb Protoc; 2010; doi:10.1101/pdb.prot5407) may be used to deliver Cas9 and guide RNA across the blood brain barrier.

Example 21: Therapeutic Strategies for Trinucleotide Repeat Disorders; Guide Design As previously mentioned in the application, the target polynucleotide of a CRISPR complex may include a number of disease-associated genes and polynucleotides and some of these disease associated gene may belong to a set of genetic disorders referred to as Trinucleotide repeat disorders (referred to as also trinucleotide repeat expansion disorders, triplet repeat expansion disorders or codon reiteration disorders).

These diseases are caused by mutations in which the trinucleotide repeats of certain genes exceed the normal, stable threshold which may usually differ in a gene. The discovery of more repeat expansion disorders has allowed for the classification of these disorders into a number of categories based on underlying similar characteristics. Huntington's disease (HD) and the spinocerebellar ataxias that are caused by a CAG repeat expansion in protein-coding portions of specific genes are included in Category I. Diseases or disorders with expansions that tend to make them phenotypically diverse and include expansions are usually small in magnitude and also found in exons of genes are included in Category II. Category III includes disorders or diseases which are characterized by much larger repeat expansions than either Category I or II and are generally located outside protein coding regions. Examples of Category III diseases or disorders include but are not limited to Fragile X syndrome, myotonic dystrophy, two of the spinocerebellar ataxias, juvenile myoclonic epilepsy, and Friedreich's ataxia.

Figure 32A:
FIG. 32A-B (a) shows a schematic of the GAA repeat expansion in FXN intron 1 and (b) shows a schematic of the strategy adopted to excise the GAA expansion region using the CRISPR/Cas system.

Similar therapeutic strategies, like the one mentioned for Friedreich's ataxia below may be adopted to address other trinucleotide repeat or expansion disorders as well. For example, another triple repeat disease that can be treated using almost identical strategy is dystrophia myotonica 1 (DM1), where there is an expanded CTG motif in the 3' UTR. In Friedreich's ataxia, the disease results from expansion of GAA trinucleotides in the first intron of frataxin (FXN). One therapeutic strategy using CRISPR is to excise the GAA repeat from the first intron. The expanded GAA repeat is thought to affect the DNA structure and leads to recruit the formation of heterochromatin which turn off the frataxin gene (FIG. 32A).

Competitive Advantage Over Other Therapeutic Strategies are Listed Below:

siRNA knockdown is not applicable in this case, as disease is due to reduced expression of frataxin. Viral gene therapy is currently being explored. HSV-1 based vectors were used to deliver the frataxin gene in animal models and have shown therapeutic effect. However, long term efficacy of virus-based frataxin delivery suffer from several problems: First, it is difficult to regulate the expression of frataxin to match natural levels in health individuals, and second, long term over expression of frataxin leads to cell death.

Nucleases may be used to excise the GAA repeat to restore healthy genotype, but Zinc Finger Nuclease and TALEN strategies require delivery of two pairs of high efficacy nucleases, which is difficult for both delivery as well as nuclease engineering (efficient excision of genomic DNA by ZFN or TALEN is difficult to achieve).

In contrast to above strategies, the CRISPR-Cas system has clear advantages. The Cas9 enzyme is more efficient and more multiplexible, by which it is meant that one or more targets can be set at the same time. So far, efficient excision of genomic DNA >30% by Cas9 in human cells and may be as high as 30%, and may be improved in the future. Furthermore, with regard to certain trinucleotide repeat disorders like Huntington's disease (HD), trinucleotide repeats in the coding region may be addressed if there are differences between the two alleles. Specifically, if a HD patient is heterozygous for mutant HTT and there are nucleotide differences such as SNPs between the wt and mutant HTT alleles, then Cas9 may be used to specifically target the mutant HTT allele. ZFN or TALENs will not have the ability to distinguish two alleles based on single base differences.

Figure 32B:
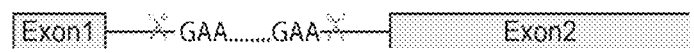

In adopting a strategy using the CRISPR-Cas9 enzyme to address Friedreich's ataxia, Applicants design a number of guide RNAs targeting sites flanking the GAA expansion and the most efficient and specific ones are chosen (FIG. 32B).

Applicants deliver a combination of guide RNAs targeting the intron 1 of FXN along with Cas9 to mediate excision of the GAA expansion region. AAV9 may be used to mediate efficient delivery of Cas9 and in the spinal cord.

If the Alu element adjacent to the GAA expansion is considered important, there may be constraints to the number of sites that can be targeted but Applicants may adopt strategies to avoid disrupting it.

Alternative Strategies:

Rather than modifying the genome using Cas9, Applicants may also directly activate the FXN gene using Cas9 (nuclease activity deficient)-based DNA binding domain to target a transcription activation domain to the FXN gene.

Example 22: Strategies for Minimizing Off-Target Cleavage Using Cas9 Nickase

As previously mentioned in the application, Cas9 may be mutated to mediate single strand cleavage via one or more of the following mutations: D10A, E762A, and H840A.

To mediate gene knockout via NHEJ, Applicants use a nickase version of Cas9 along with two guide RNAs. Off-target nicking by each individual guide RNA may be primarily repaired without mutation, double strand breaks (which can lead to mutations via NHEJ) only occur when the target sites are adjacent to each other. Since double strand breaks introduced by double nicking are not blunt, co-expression of end-processing enzymes such as TREX1 will increase the level of NHEJ activity.

The following list of targets in tabular form are for genes involved in the following diseases:

Lafora's Disease—target GSY1 or PPP1R3C (PTG) to reduce glycogen in neurons.

Hypercholesterolemia—Target PCSK9

Target sequences are listed in pairs (L and R) with different number of nucleotides in the spacer (0 to 3 bp). Each spacer may also be used by itself with the wild type Cas9 to introduce double strand break at the target locus.

TABLE 11

| | | | |
|---|---|---|---|
| GYS1 (human) | GGCC-L | ACCCTTGTTAGCCACCTCCC | SEQ ID NO: 1497 |
| | GGCC-R | GAACGCAGTGCTCTTCGAAG | SEQ ID NO: 1498 |
| | GGNCC-L | CTCACGCCCTGCTCCGTGTA | SEQ ID NO: 1499 |
| | GGNCC-R | GGCGACAACTACTTCCTGGT | SEQ ID NO: 1500 |
| | GGNNCC-L | CTCACGCCCTGCTCCGTGTA | SEQ ID NO: 1501 |
| | GGNNCC-R | GGGCGACAACTACTTCCTGG | SEQ ID NO: 1502 |
| | GGNNNCC-L | CCTCTTCAGGGCCGGGGTGG | SEQ ID NO: 1503 |
| | GGNNNCC-R | GAGGACCCAGGTGGAACTGC | SEQ ID NO: 1504 |
| PCSK9 (human) | GGCC-L | TCAGCTCCAGGCGGTCCTGG | SEQ ID NO: 1505 |
| | GGCC-R | AGCAGCAGCAGCAGTGGCAG | SEQ ID NO: 1506 |
| | GGNCC-L | TGGGCACCGTCAGCTCCAGG | SEQ ID NO: 1507 |
| | GGNCC-R | CAGCAGTGGCAGCGGCCACC | SEQ ID NO: 1508 |
| | GGNNCC-L | ACCTCTCCCCTGGCCCTCAT | SEQ ID NO: 1509 |
| | GGNNCC-R | CCAGGACCGCCTGGAGCTGA | SEQ ID NO: 1510 |

TABLE 11-continued

| | | | |
|---|---|---|---|
| | GGNNNCC-L | CCGTCAGCTCCAGGCGGTCC | SEQ ID NO: 1511 |
| | GGNNNCC-R | AGCAGCAGCAGCAGTGGCAG | SEQ ID NO: 1512 |
| PPP1R3C (PTG) (human) | GGCC-L | ATGTGCCAAGCAAAGCCTCA | SEQ ID NO: 1513 |
| | GGCC-R | TTCGGTCATGCCCGTGGATG | SEQ ID NO: 1514 |
| | GGNCC-L | GTCGTTGAAATTCATCGTAC | SEQ ID NO: 1515 |
| | GGNCC-R | ACCACCTGTGAAGAGTTTCC | SEQ ID NO: 1516 |
| | GGNNCC-L | CGTCGTTGAAATTCATCGTA | SEQ ID NO: 1517 |
| | GGNNCC-R | ACCACCTGTGAAGAGTTTCC | SEQ ID NO: 1518 |
| Gys1 (mouse) | GGCC-L | GAACGCAGTGCTTTTCGAGG | SEQ ID NO: 1519 |
| | GGCC-R | ACCCTTGTTGGCCACCTCCC | SEQ ID NO: 1520 |
| | GGNCC-L | GGTGACAACTACTATCTGGT | SEQ ID NO: 1521 |
| | GGNCC-R | CTCACACCCTGCTCCGTGTA | SEQ ID NO: 1522 |
| | GGNNCC-L | GGGTGACAACTACTATCTGG | SEQ ID NO: 1523 |
| | GGNNCC-R | CTCACACCCTGCTCCGTGTA | SEQ ID NO: 1524 |
| | GGNNNCC-L | CGAGAACGCAGTGCTTTTCG | SEQ ID NO: 1525 |
| | GGNNNCC-R | ACCCTTGTTGGCCACCTCCC | SEQ ID NO: 1526 |
| PPP1R3C (PTG) (mouse) | GGCC-L | ATGAGCCAAGCAAATCCTCA | SEQ ID NO: 1527 |
| | GGCC-R | TTCCGTCATGCCCGTGGACA | SEQ ID NO: 1528 |
| | GGNCC-L | CTTCGTTGAAAACCATTGTA | SEQ ID NO: 1529 |
| | GGNCC-R | CCACCTCTGAAGAGTTTCCT | SEQ ID NO: 1530 |
| | GGNNCC-L | CTTCGTTGAAAACCATTGTA | SEQ ID NO: 1531 |
| | GGNNCC-R | ACCACCTCTGAAGAGTTTCC | SEQ ID NO: 1532 |
| | GGNNNCC-L | CTTCCACTCACTCTGCGATT | SEQ ID NO: 1533 |
| | GGNNNCC-R | ACCATGTCTCAGTGTCAAGC | SEQ ID NO: 1534 |
| PCSK9 (mouse) | GGCC-L | GGCGGCAACAGCGGCAACAG | SEQ ID NO: 1535 |
| | GGCC-R | ACTGCTCTGCGTGGCTGCGG | SEQ ID NO: 1536 |
| | GGNNCC-L | CCGCAGCCACGCAGAGCAGT | SEQ ID NO: 1537 |
| | GGNNCC-R | GCACCTCTCCTCGCCCCGAT | SEQ ID NO: 1538 |

Alternative strategies for improving stability of guide RNA and increasing specificity
1. Nucleotides in the 5' of the guide RNA may be linked via thiolester linkages rather than phosphoester linkage like in natural RNA. Thiolester linkage may prevent the guide RNA from being digested by endogenous RNA degradation machinery.
2. Nucleotides in the guide sequence (5' 20 bp) of the guide RNA can use bridged nucleic acids (BNA) as the bases to improve the binding specificity.

Example 23: CRISPR-Cas for Rapid, Multiplex Genome Editing

Aspects of the invention relate to protocols and methods by which efficiency and specificity of gene modification may be tested within 3-4 days after target design, and modified clonal cell lines may be derived within 2-3 weeks.

Programmable nucleases are powerful technologies for mediating genome alteration with high precision. The RNA-guided Cas9 nuclease from the microbial CRISPR adaptive immune system can be used to facilitate efficient genome editing in eukaryotic cells by simply specifying a 20-nt targeting sequence in its guide RNA. Applicants describe a set of protocols for applying Cas9 to facilitate efficient genome editing in mammalian cells and generate cell lines for downstream functional studies. Beginning with target design, efficient and specific gene modification can be achieved within 3-4 days, and modified clonal cell lines can be derived within 2-3 weeks.

The ability to engineer biological systems and organisms holds enormous potential for applications across basic science, medicine, and biotechnology. Programmable sequence-specific endonucleases that facilitate precise editing of endogenous genomic loci are now enabling systematic interrogation of genetic elements and causal genetic variations in a broad range of species, including those that have not been genetically tractable previously. A number of genome editing technologies have emerged in recent years, including zinc finger nucleases (ZFNs), transcription activator-like effector nucleases (TALENs), and the RNA-guided CRISPR-Cas nuclease system. The first two technologies use a common strategy of tethering endonuclease catalytic domains to modular DNA-binding proteins for inducing targeted DNA double stranded breaks (DSB) at specific genomic loci. By contrast, Cas9 is a nuclease guided by small RNAs through Watson-Crick base-pairing with target DNA, presenting a system that is easy to design, efficient, and well-suited for high-throughput and multiplexed gene editing for a variety of cell types and organisms. Here Applicants describe a set of protocols for applying the recently developed Cas9 nuclease to facilitate efficient genome editing in mammalian cells and generate cell lines for downstream functional studies.

Like ZFNs and TALENs, Cas9 promotes genome editing by stimulating DSB at the target genomic loci. Upon cleavage by Cas9, the target locus undergoes one of two major pathways for DNA damage repair, the error-prone non-homologous end joining (NHEJ) or the high-fidelity homology directed repair (HDR) pathway. Both pathways may be utilized to achieve the desired editing outcome.

NHEJ: In the absence of a repair template, the NHEJ process re-ligates DSBs, which may leave a scar in the form of indel mutations. This process can be harnessed to achieve gene knockouts, as indels occurring within a coding exon may lead to frameshift mutations and a premature stop codon. Multiple DSBs may also be exploited to mediate larger deletions in the genome.

HDR: Homology directed repair is an alternate major DNA repair pathway to NHEJ. Although HDR typically occurs at lower frequencies than NHEJ, it may be harnessed to generate precise, defined modifications at a target locus in the presence of an exogenously introduced repair template. The repair template may be either in the form of double stranded DNA, designed similarly to conventional DNA targeting constructs with homology arms flanking the insertion sequence, or single-stranded DNA oligonucleotides (ssODNs). The latter provides an effective and simple method for making small edits in the genome, such as the introduction of single nucleotide mutations for probing causal genetic variations. Unlike NHEJ, HDR is generally active only in dividing cells and its efficiency varies depending on the cell type and state.

Overview of CRISPR: The CRISPR-Cas system, by contrast, is at minimum a two-component system consisting of the Cas9 nuclease and a short guide RNA. Re-targeting of Cas9 to different loci or simultaneous editing of multiple genes simply requires cloning a different 20-bp oligonucleotide. Although specificity of the Cas9 nuclease has yet to be thoroughly elucidated, the simple Watson-Crick base-pairing of the CRISPR-Cas system is likely more predictable than that of ZFN or TALEN domains.

The type II CRISPR-Cas (clustered regularly interspaced short palindromic repeats) is a bacterial adaptive immune system that uses Cas9, to cleave foreign genetic elements. Cas9 is guided by a pair of non-coding RNAs, a variable crRNA and a required auxiliary tracrRNA. The crRNA contains a 20-nt guide sequence determines specificity by locating the target DNA via Watson-Crick base-pairing. In the native bacterial system, multiple crRNAs are co-transcribed to direct Cas9 against various targets. In the CRISPR-Cas system derived from *Streptococcus pyogenes*, the target DNA must immediately precede a 5'-NGG/NRG protospacer adjacent motif (PAM), which can vary for other CRISPR systems.

CRISPR-Cas is reconstituted in mammalian cells through the heterologous expression of human codon-optimized Cas9 and the requisite RNA components. Furthermore, the crRNA and tracrRNA can be fused to create a chimeric, synthetic guide RNA (sgRNA). Cas9 can thus be re-directed toward any target of interest by altering the 20-nt guide sequence within the sgRNA.

Given its ease of implementation and multiplex capability, Cas9 has been used to generate engineered eukaryotic cells carrying specific mutations via both NHEJ and HDR. In addition, direct injection of sgRNA and mRNA encoding Cas9 into embryos has enabled the rapid generation of transgenic mice with multiple modified alleles; these results hold promise for editing organisms that are otherwise genetically intractable.

A mutant Cas9 carrying a disruption in one of its catalytic domains has been engineered to nick rather than cleave DNA, allowing for single-stranded breaks and preferential repair through HDR, potentially ameliorating unwanted indel mutations from off-target DSBs. Additionally, a Cas9 mutant with both DNA-cleaving catalytic residues mutated has been adapted to enable transcriptional regulation in *E. coli*, demonstrating the potential of functionalizing Cas9 for diverse applications. Certain aspects of the invention relate to the construction and application of Cas9 for multiplexed editing of human cells.

Applicants have provided a human codon-optimized, nuclear localization sequence-flanked Cas9 to facilitate eukaryotic gene editing. Applicants describe considerations for designing the 20-nt guide sequence, protocols for rapid construction and functional validation of sgRNAs, and finally use of the Cas9 nuclease to mediate both NHEJ- and HDR-based genome modifications in human embryonic kidney (HEK-293FT) and human stem cell (HUES9) lines. This protocol can likewise be applied to other cell types and organisms.

Target selection for sgRNA: There are two main considerations in the selection of the 20-nt guide sequence for gene targeting: 1) the target sequence should precede the 5'-NGG PAM for *S. pyogenes* Cas9, and 2) guide sequences should be chosen to minimize off-target activity. Applicants provided an online Cas9 targeting design tool that takes an input sequence of interest and identifies suitable target sites. To experimentally assess off-target modifications for each sgRNA, Applicants also provide computationally predicted off-target sites for each intended target, ranked according to Applicants' quantitative specificity analysis on the effects of base-pairing mismatch identity, position, and distribution.

The detailed information on computationally predicted off-target sites is as follows:

Considerations for Off-target Cleavage Activities: Similar to other nucleases, Cas9 can cleave off-target DNA targets in the genome at reduced frequencies. The extent to which a given guide sequence exhibit off-target activity depends on a combination of factors including enzyme concentration, thermodynamics of the specific guide sequence employed, and the abundance of similar sequences in the target genome. For routine application of Cas9, it is important to consider ways to minimize the degree of off-target cleavage and also to be able to detect the presence of off-target cleavage.

Minimizing off-target activity: For application in cell lines, Applicants recommend following two steps to reduce the degree of off-target genome modification. First, using Applicants' online CRISPR target selection tool, it is possible to computationally assess the likelihood of a given guide sequence to have off-target sites. These analyses are performed through an exhaustive search in the genome for off-target sequences that are similar sequences as the guide sequence. Comprehensive experimental investigation of the effect of mismatching bases between the sgRNA and its target DNA revealed that mismatch tolerance is 1) position dependent—the 8-14 bp on the 3' end of the guide sequence are less tolerant of mismatches than the 5' bases, 2) quantity dependent—in general more than 3 mismatches are not tolerated, 3) guide sequence dependent—some guide sequences are less tolerant of mismatches than others, and 4) concentration dependent—off-target cleavage is highly sensitive to the amount of transfected DNA. The Applicants' target site analysis web tool (available at the website genome-engineering.org/tools) integrates these criteria to provide predictions for likely off-target sites in the target genome. Second, Applicants recommend titrating the amount of Cas9 and sgRNA expression plasmid to minimize off-target activity.

Detection of off-target activities: Using Applicants' CRISPR targeting web tool, it is possible to generate a list of most likely off-target sites as well as primers performing SURVEYOR or sequencing analysis of those sites. For isogenic clones generated using Cas9, Applicants strongly recommend sequencing these candidate off-target sites to check for any undesired mutations. It is worth noting that there may be off target modifications in sites that are not included in the predicted candidate list and full genome sequence should be performed to completely verify the absence of off-target sites. Furthermore, in multiplex assays where several DSBs are induced within the same genome, there may be low rates of translocation events and can be evaluated using a variety of techniques such as deep sequencing.

The online tool provides the sequences for all oligos and primers necessary for 1) preparing the sgRNA constructs, 2) assaying target modification efficiency, and 3) assessing cleavage at potential off-target sites. It is worth noting that because the U6 RNA polymerase III promoter used to express the sgRNA prefers a guanine (G) nucleotide as the first base of its transcript, an extra G is appended at the 5' of the sgRNA where the 20-nt guide sequence does not begin with G.

Approaches for sgRNA construction and delivery: Depending on the desired application, sgRNAs may be delivered as either 1) PCR amplicons containing an expression cassette or 2) sgRNA-expressing plasmids. PCR-based sgRNA delivery appends the custom sgRNA sequence onto the reverse PCR primer used to amplify a U6 promoter template. The resulting amplicon may be co-transfected with a plasmid containing Cas9 (PX165). This method is optimal for rapid screening of multiple candidate sgRNAs, as cell transfections for functional testing can be performed mere hours after obtaining the sgRNA-encoding primers. Because this simple method obviates the need for plasmid-based cloning and sequence verification, it is well suited for testing or co-transfecting a large number of sgRNAs for generating large knockout libraries or other scale-sensitive applications. Note that the sgRNA-encoding primers are over 100-bp, compared to the ~20-bp oligos required for plasmid-based sgRNA delivery.

Construction of an expression plasmid for sgRNA is also simple and rapid, involving a single cloning step with a pair of partially complementary oligonucleotides. After annealing the oligo pairs, the resulting guide sequences may be inserted into a plasmid bearing both Cas9 and an invariant scaffold bearing the remainder of the sgRNA sequence (PX330). The transfection plasmids may also be modified to enable virus production for in vivo delivery.

In addition to PCR and plasmid-based delivery methods, both Cas9 and sgRNA can be introduced into cells as RNA.

Design of repair template: Traditionally, targeted DNA modifications have required use of plasmid-based donor repair templates that contain homology arms flanking the site of alteration. The homology arms on each side can vary in length, but are typically longer than 500 bp. This method can be used to generate large modifications, including insertion of reporter genes such as fluorescent proteins or antibiotic resistance markers. The design and construction of targeting plasmids has been described elsewhere.

More recently, single-stranded DNA oligonucleotides (ssODNs) have been used in place of targeting plasmids for short modifications within a defined locus without cloning. To achieve high HDR efficiencies, ssODNs contain flanking sequences of at least 40 bp on each side that are homologous to the target region, and can be oriented in either the sense or antisense direction relative to the target locus.

Functional Testing

SURVEYOR nuclease assay: Applicants detected indel mutations either by the SURVEYOR nuclease assay (or PCR amplicon sequencing. Applicants online CRISPR target design tool provides recommended primers for both approaches. However, SURVEYOR or sequencing primers may also be designed manually to amplify the region of interest from genomic DNA and to avoid non-specific amplicons using NCBI Primer-BLAST. SURVEYOR primers should be designed to amplify 300-400 bp (for a 600-800 bp total amplicon) on either side of the Cas9 target for allowing clear visualization of cleavage bands by gel electrophoresis. To prevent excessive primer dimer formation, SURVEYOR primers should be designed to be typically under 25-nt long with melting temperatures of ~60° C. Applicants recommend testing each pair of candidate primers for specific PCR amplicons as well as for the absence of non-specific cleavage during the SURVEYOR nuclease digestion process.

Plasmid- or ssODN-mediated HDR: HDR can be detected via PCR-amplification and sequencing of the modified region. PCR primers for this purpose should anneal outside the region spanned by the homology arms to avoid false detection of residual repair template (HDR Fwd and Rev, FIG. 30). For ssODN-mediated HDR, SURVEYOR PCR primers can be used.

Detection of indels or HDR by sequencing: Applicants detected targeted genome modifications by either Sanger or next-generation deep sequencing (NGS). For the former, genomic DNA from modified region can be amplified using either SURVEYOR or HDR primers. Amplicons should be subcloned into a plasmid such as pUC19 for transformation; individual colonies can be sequenced to reveal clonal genotype.

Applicants designed next-generation sequencing (NGS) primers for shorter amplicons, typically in the 100-200 bp size range. For detecting NHEJ mutations, it is important to design primers with at least 10-20 bp between the priming regions and the Cas9 target site to allow detection of longer indels. Applicants provide guidelines for a two-step PCR method to attach barcoded adapters for multiplex deep sequencing. Applicants recommend the Illumina platform, due to its generally low levels of false positive indels. Off-target analysis (described previously) can then be performed through read alignment programs such as ClustalW, Geneious, or simple sequence analysis scripts.

Materials and Reagents

Sgrna Preparation:

UltraPure DNaseRNase-free distilled water (Life Technologies, cat. no. 10977-023)

Herculase II fusion polymerase (Agilent Technologies, cat. no. 600679)

CRITICAL. Standard Taq polymerase, which lacks 3'-5' exonuclease proofreading activity, has lower fidelity and can lead to amplification errors. Herculase II is a high-fidelity polymerase (equivalent fidelity to Pfu) that produces high yields of PCR product with minimal optimization. Other high-fidelity polymerases may be substituted.

Herculase II reaction buffer (5×; Agilent Technologies, included with polymerase)

dNTP solution mix (25 mM each; Enzymatics, cat. no. N205L)

MgCl2 (25 mM; ThermoScientific, cat. no. R0971)

QIAquick gel extraction kit (Qiagen, cat. no. 28704)

QIAprep spin miniprep kit (Qiagen, cat. no. 27106)

UltraPure TBE buffer (10×; Life Technologies, cat. no. 15581-028)

SeaKem LE agarose (Lonza, cat. no. 50004)

SYBR Safe DNA stain (10,000×; Life Technologies, cat. no. S33102)

1-kb Plus DNA ladder (Life Technologies, cat. no. 10787-018)

TrackIt CyanOrange loading buffer (Life Technologies, cat. no. 10482-028)

FastDigest BbsI (BpiI) (Fermentas/ThermoScientific, cat. no. FD1014)

Fermentas Tango Buffer (Fermentas/ThermoScientific, cat. no. BY5)

DL-dithiothreitol (DTT; Fermentas/ThermoScientific, cat. no. R0862)

T7 DNA ligase (Enzymatics, cat. no. L602L)

Critical: Do not substitute the more commonly used T4 ligase. T7 ligase has 1,000-fold higher activity on the sticky ends than on the blunt ends and higher overall activity than commercially available concentrated T4 ligases.

T7 2× Rapid Ligation Buffer (included with T7 DNA ligase, Enzymatics, cat. no. L602L)

T4 Polynucleotide Kinase (New England Biolabs, cat. no M0201S)

T4 DNA Ligase Reaction Buffer (10×; New England Biolabs, cat. no B0202S)

Adenosine 5'-triphosphate (10 mM; New England Biolabs, cat. no. P0756S)

PlasmidSafe ATP-dependent DNase (Epicentre, cat. no. E3101K)

One Shot Stbl3 chemically competent *Escherichia coli* (*E. coli*) (Life Technologies, cat. no. C7373-03)

SOC medium (New England Biolabs, cat. no. B9020S)

LB medium (Sigma, cat. no. L3022)

LB agar medium (Sigma, cat. no. L2897)

Ampicillin, sterile filtered (100 mg ml-1; Sigma, cat. no. A5354)

Mammalian Cell Culture:

HEK293FT cells (Life Technologies, cat. no. R700-07)

Dulbecco's minimum Eagle's medium (DMEM, 1×, high glucose; Life Technologies, cat. no. 10313-039)

Dulbecco's minimum Eagle's medium (DMEM, 1×, high glucose, no phenol red; Life Technologies, cat. no. 31053-028)

Dulbecco's phosphate-buffered saline (DPBS, 1×; Life Technologies, cat. no. 14190-250)

Fetal bovine serum, qualified and heat inactivated (Life Technologies, cat. no. 10438-034)

Opti-MEM I reduced-serum medium (FBS; Life Technologies, cat. no. 11058-021)

Penicillin-streptomycin (100×; Life Technologies, cat. no. 15140-163)

TrypLE™ Express (1×, no Phenol Red; Life Technologies, cat. no. 12604-013)

Lipofectamine 2000 transfection reagent (Life Technologies, cat. no. 11668027)

Amaxa SF Cell Line 4D-Nucleofector® X Kit S (32 RCT; Lonza, cat. no V4XC-2032)

HUES 9 cell line (HARVARD STEM CELL SCIENCE)

Geltrex LDEV-Free Reduced Growth Factor Basement Membrane Matrix (Life Technologies, cat. no. A1413201)

mTeSR1 medium (Stemcell Technologies, cat. no. 05850)

Accutase cell detachment solution (Stemcell Technologies, cat. no. 07920)

ROCK Inhibitor (Y-27632; Millipore, cat. no. SCM075)

Amaxa P3 Primary Cell 4D-Nucleofector® X Kit S (32 RCT; Lonza cat. no. V4XP-3032)

Genotyping Analysis:

QuickExtract DNA extraction solution (Epicentre, cat. no. QE09050)

PCR primers for SURVEYOR, RFLP analysis, or sequencing (see Primer table)

Herculase II fusion polymerase (Agilent Technologies, cat. no. 600679)

CRITICAL. As Surveyor assay is sensitive to single-base mismatches, it is particularly important to use a high-fidelity polymerase. Other high-fidelity polymerases may be substituted.

Herculase II reaction buffer (5×; Agilent Technologies, included with polymerase)

dNTP solution mix (25 mM each; Enzymatics, cat. no. N205L)

QIAquick gel extraction kit (Qiagen, cat. no. 28704)

Taq Buffer (10×; Genscript, cat. no. B0005)

SURVEYOR mutation detection kit for standard gel electrophoresis (Transgenomic, cat. no. 706025)

UltraPure TBE buffer (10×; Life Technologies, cat. no. 15581-028)

SeaKem LE agarose (Lonza, cat. no. 50004)

4-20% TBE Gels 1.0 mm, 15 Well (Life Technologies, cat. no. EC62255BOX)

Novex® Hi-Density TBE Sample Buffer (5×; Life Technologies, cat. no. LC6678)

SYBR Gold Nucleic Acid Gel Stain (10,000×; Life Technologies, cat. no. S-11494)

1-kb Plus DNA ladder (Life Technologies, cat. no. 10787-018)

TrackIt CyanOrange loading buffer (Life Technologies, cat. no. 10482-028)

FastDigest HindIII (Fermentas/ThermoScientific, cat. no. FD0504)

Equipment

Filtered sterile pipette tips (Corning)

Standard 1.5 ml microcentrifuge tubes (Eppendorf, cat. no. 0030 125.150)

Axygen 96-well PCR plates (VWR, cat. no. PCR-96M2-HSC)

Axygen 8-Strip PCR tubes (Fischer Scientific, cat. no. 14-222-250)

Falcon tubes, polypropylene, 15 nl (BD Falcon, cat. no. 352097)

Falcon tubes, polypropylene, 50 ml (BD Falcon, cat. no. 352070)

Round-bottom Tube with cell strainer cap, 5 nl (BD Falcon, cat. no. 352235)

Petri dishes (60 mm×15 mm; BD Biosciences, cat. no. 351007)

Tissue culture plate (24 well: BD Falcon, cat. no. 353047)

Tissue culture plate (96 well, flat bottom; BD Falcon, cat. no. 353075)

Tissue culture dish (100 mm; BD Falcon, 353003)

96-well thermocycler with programmable temperature stepping functionality (Applied Biosystems Veriti, cat. no. 4375786).

Desktop microcentrifuges 5424, 5804 (Eppendorf)

Gel electrophoresis system (PowerPac basic power supply, Bio-Rad, cat. no. 164-5050, and Sub-Cell GT System gel tray, Bio-Rad, cat. no. 170-4401)

Novex XCell SureLock Mini-Cell (Life Technologies, cat. no. EI0001)

Digital gel imaging system (GelDoc EZ, Bio-Rad, cat. no. 170-8270, and blue sample tray, Bio-Rad, cat. no. 170-8273)

Blue light transilluminator and orange filter goggles (SafeImager 2.0; Invitrogen, cat. no. G6600)

Gel quantification software (Bio-Rad, ImageLab, included with GelDoc EZ,or open-source ImageJ from the National Institutes of Health, available at the website rsbweb.nih.gov/ij/) UV spectrophotometer (NanoDrop 2000c, Thermo Scientific)

Reagent Setup

Tris-borate EDTA (TBE) electrophoresis solution Dilute TBE buffer in distilled water to 1× working solution for casting agarose gels and for use as a buffer for gel electrophoresis. Buffer may be stored at room temperature (18-22° C.) for at least 1 year.

ATP, 10 mM Divide 10 mM ATP into 50-μl aliquots and store at −20° C. for up to 1 year; avoid repeated freeze-thaw cycles.

DTT, 10 mM Prepare 10 mM DTT solution in distilled water and store in 20-μl aliquots at −70° C. for up to 2 years; for each reaction, use a new aliquot, as DTT is easily oxidized.

D10 culture medium For culture of HEK293FT cells, prepare D10 culture medium by supplementing DMEM with 1× GlutaMAX and 10% (vol/vol) fetal bovine serum. As indicated in the protocol, this medium can also be supplemented with 1× penicillin-streptomycin. D10 medium can be made in advance and stored at 4° C. for up to 1 month.

mTeSR1 culture medium For culture of human embryonic stem cells, prepare mTeSR1 medium by supplementing the 5× supplement (included with mTeSR1 basal medium), and 100 μg/ml Normocin.

Procedure

Design of Targeting Components and Use of the Online Tool•Timing 1 d

1| Input target genomic DNA sequence. Applicants provide an online Cas9 targeting design tool that takes an input sequence of interest, identifies and ranks suitable target sites, and computationally predicts off-target sites for each intended target. Alternatively, one can manually select guide sequence by identifying the 20-bp sequence directly upstream of any 5'-NGG.

2| Order necessary oligos and primers as specified by the online tool. If the site is chosen manually, the oligos and primers should be designed.

Preparation of sgRNA Expression Construct

3| To generate the sgRNA expression construct, either the PCR- or plasmid-based protocol can be used.

(A) via PCR amplification•Timing 2 h (i) Applicants prepare diluted U6 PCR template. Applicants recommend using PX330 as a PCR template, but any U6-containing plasmid may likewise be used as the PCR template. Applicants diluted template with ddH$_2$O to a concentration of 10 ng/ul. Note that if a plasmid or cassette already containing an U6-driven sgRNA is used as a template, a gel extraction needs to be performed to ensure that the product contains only the intended sgRNA and no trace sgRNA carryover from template.

(ii) Applicants prepared diluted PCR oligos. U6-Fwd and U6-sgRNA-Rev primers are diluted to a final concentration of 10 uM in ddH$_2$O (add 10 ul of 100 uM primer to 90 ul ddH$_2$O).

(iii) U6-sgRNA PCR reaction. Applicants set up the following reaction for each U6-sgRNA-Rev primer and mastermix as needed:

| Component: | Amount (ul) | Final concentration |
| --- | --- | --- |
| Herculase II PCR buffer, 5X | 10 | 1X |
| dNTP, 100 mM (25 mM each) | 0.5 | 1 mM |
| U6 template (PX330) | 1 | 0.2 ng/ul |
| U6-Fwd primer | 1 | 0.2 uM |
| U6-sgRNA-Rev primer (variable) | 1 | 0.2 uM |
| Herculase II Fusion polymerase | 0.5 | |
| Distilled water | 36 | |
| Total | 50 | |

(iv) Applicants performed PCR reaction on the reactions from step (iii) using the following cycling conditions:

| Cycle number | Denature | Anneal | Extend |
| --- | --- | --- | --- |
| 1 | 95° C., 2 m | | |
| 2-31 | 95° C., 20 s | 60° C., 20 s | 72° C., 20 s |
| 32 | | | 72° C., 3 m |

(v) After the reaction is completed, Applicants ran the product on a gel to verify successful, single-band amplification. Cast a 2% (wt/vol) agarose gel in 1× TBE buffer with 1× SYBR Safe dye. Run 5 ul of the PCR product in the gel at 15 V cm-1 for 20-30 min. Successful amplicons should yield one single 370-bp product and the template should be invisible. It should not be necessary to gel extract the PCR amplicon.

(vi) Applicants purified the PCR product using the QIAquick PCR purification kit according to the manufacturer's directions. Elute the DNA in 35 ul of Buffer EB or water. Purified PCR products may be stored at 4° C. or −20° C.

(B) Cloning sgRNA into Cas9-containing bicistronic expression vector•Timing 3 d (i) Prepare the sgRNA oligo inserts. Applicants resuspended the top and bottom strands of oligos for each sgRNA design to a final concentration of 100 uM. Phosphorylate and anneal the oligo as follows:

| | |
|---|---|
| Oligo 1 (100 uM) | 1 ul |
| Oligo 2 (100 uM) | 1 ul |
| T4 Ligation Buffer, 10X | 1 ul |
| T4 PNK | 1 ul |
| ddH$_2$O | 6 ul |
| Total | 10 ul |

(ii) Anneal in a thermocycler using the following parameters:
37° C. for 30 m
95° C. for 5 m
Ramp down to 25° C. at 5° C. per m (iii) Applicants diluted phosphorylated and annealed oligos 1:200 by add 1 ul of oligo to 199 ul room temperature ddH$_2$O.

(iv) Clone sgRNA oligo into PX330. Applicants set up Golden Gate reaction for each sgRNA. Applicants recommend also setting up a no-insert, PX330 only negative control.

| | |
|---|---|
| PX330 (100 ng) | x ul |
| Diluted oligo duplex from step (iii) | 2 ul |
| Tango Buffer, 10X | 2 ul |
| DTT, 10 mM | 1 ul |
| ATP, 10 mM | 1 ul |
| FastDigest BbsI | 1 ul |
| T7 Ligase | 0.5 ul |
| ddH$_2$O | x ul |
| Total | 20 ul |

(v) Incubate the Golden Gate reaction for a total of 1 h:

| Cycle number | Condition |
|---|---|
| 1-6 | 37° C. for 5 m, 21° C. for 5 m |

(vi) Applicants treated Golden Gate reaction with PlasmidSafe exonuclease to digest any residual linearized DNA. This step is optional but highly recommended.

| | |
|---|---|
| Golden Gate reaction from step 4 | 11 ul |
| 10X PlasmidSafe Buffer | 1.5 ul |
| ATP, 10 mM | 1.5 ul |
| PlasmidSafe exonuclease | 1 ul |
| Total | 15 ul |

(vii) Applicants incubated the PlasmidSafe reaction at 37° C. for 30 min, followed by inactivation at 70° C. for 30 min. Pause point: after completion, the reaction may be frozen and continued later. The circular DNA should be stable for at least 1 week.

(viii) Transformation. Applicants transformed the PlasmidSafe-treated plasmid into a competent E. coli strain, according to the protocol supplied with the cells. Applicants recommend Stbl3 for quick transformation. Briefly, Applicants added 5 ul of the product from step (vii) into 20 ul of ice-cold chemically competent Stbl3 cells. This is then incubated on ice for 10 m, heat shocked at 42° C. for 30 s, returned immediately to ice for 2 m, 100 ul of SOC medium is added, and this is plated onto an LB plate containing 100 μg/ml ampicillin with incubation overnight at 37° C.

(ix) Day 2: Applicants inspected plates for colony growth. Typically, there are no colonies on the negative control plates (ligation of BbsI-digested PX330 only, no annealed sgRNA oligo), and tens to hundreds of colonies on the PX330-sgRNA cloning plates.

(x) From each plate, Applicants picked 2-3 colonies to check correct insertion of sgRNA. Applicants used a sterile pipette tip to inoculate a single colony into a 3 ml culture of LB medium with 100 μg/ml ampicillin. Incubate and shake at 37° C. overnight.

(xi) Day 3: Applicants isolated plasmid DNA from overnight cultures using a QiAprep Spin miniprep kit according to the manufacturer's instructions.

(xii) Sequence validate CRISPR plasmid. Applicants verified the sequence of each colony by sequencing from the U6 promoter using the U6-Fwd primer. Optional: sequence the Cas9 gene using primers listed in the following Primer table.

TABLE 12

| Primer | Sequence (5' to 3') | SEQ ID NO: | Purpose |
|---|---|---|---|
| U6-For | GAGGGCCTATTTCCCATGATTCC | 1539 | Amplify U6-sgRNA |
| U6-Rev | AAAAAAAGCACCGACTCGGTGCC ACTTTTTCAAGTTGATAACGGAC TAGCCTTATTTTAACTTGCTATT TCTAGCTCTAAAACNNNNNNNNNN NNNNNNNNNNNCCGGTGTTTCGTC CTTTCCACAAG | 1540 | Amplify U6-sgRNA; N is reverse complement of target |
| sgRNA-top | CACCGNNNNNNNNNNNNNNNNNNNN N | 1541 | Clone sgRNA into PX330 |
| sgRNA-bottom | AAACNNNNNNNNNNNNNNNNNNNN C | 1542 | Clone sgRNA into PX330 |
| U6-EMX1-Rev | AAAAAAAGCACCGACTCGGTGCC ACTTTTTCAAGTTGATAACGGAC TAGCCTTATTTTAACTTGCTATT TCTAGCTCTAAAACCCCTAGTCA TTGGAGGTGACCGGTGTTTCGTC CTTTCCACAAG | 1543 | Amplify U6-EMX1 sgRNA |
| EMX1-top | CACCGTCACCTCCAATGACTAGG G | 1544 | Clone EMX1 sgRNA into PX330 |
| FMX1-bottom | AAACCCCTAGTCATTGGAGGTGA C | 1545 | Clone EMX1 sgRNA into PX330 |
| ssODN-sense | CAGAAGAAGAAGGGCTCCCATCA CATCAACCGGTGGCGCATTGCCA CGAAGCAGGCCAATGGGGAGGAC ATCGATGTCACCTCCAATGACAA GCTTGCTAGCGGTGGGCAACCAC AAACCCACGAGGGCAGAGTGCTG CTTGCTGCTGGCCAGGCCCCTGC GTGGGCCCAAGCTGGACTCTGGC CACTCCCT | 1546 | EMX1 HDR (sense; insertion underlined) |
| ssODN-antisense | AGGGAGTGGCCAGAGTCCAGCTT GGGCCCACGCAGGGGCCTGGCCA GCAGCAAGCAGCACTCTGCCCTC GTGGGTTTGTGGTTGCCCACCGC TAGCAAGCTTGTCATTGGAGGTG ACATCGATGTCCTCCCCATTGGC | 1547 | EMX1 HDR (antisense; insertion underlined) |

TABLE 12-continued

| Primer | Sequence (5' to 3') | SEQ ID NO: | Purpose |
|---|---|---|---|
| | CTGCTTCGTGGCAATGCGCCACC GGTTGATGTGATGGGAGCCCTTC TTCTTCTG | | |
| EMX1-SURV-F | CCATCCCCTTCTGTGAATGT | 1548 | EMX1 SURVEYOR assay PCR, sequencing |
| EMX1-SURV-R | GGAGATTGGAGACACGGAGA | 1549 | EMX1 SURVEYOR assay PCR, sequencing |
| EMX1-HDR-F | GGCTCCCTGGGTTCAAAGTA | 1550 | EMX1 RFLP analysis PCR, sequencing |
| EMX1-HDR-R | AGAGGGGTCTGGATGTCGTAA | 1551 | EMX1 RFLP analysis PCR, sequencing |
| pUC19-F | CGCCAGGGTTTTCCCAGTCACGA C | 1552 | pUC19 multiple cloning site F primer, for Sanger sequencing |

Applicants referenced the sequencing results against the PX330 cloning vector sequence to check that the 20 bp guide sequence was inserted between the U6 promoter and the remainder of the sgRNA scaffold. Details and sequence of the PX330 map in GenBank vector map format (*.gb file) can be found at the website crispr.genome-engineering.org. (Optional) Design of ssODN Template•Timing 3 d Planning Ahead 3| Design and order ssODN. Either the sense or antisense ssODN can be purchased directly from supplier. Applicants recommend designing homology arms of at least 40 bp on either side and 90 bp for optimal HDR efficiency. In Applicants' experience, antisense oligos have slightly higher modification efficiencies.

4| Applicants resuspended and diluted ssODN ultramers to a final concentration of 10 uM. Do not combine or anneal the sense and antisense ssODNs. Store at −20° C.

5| Note for HDR applications, Applicants recommend cloning sgRNA into the PX330 plasmid.
Functional Validation of sgRNAs: Cell Culture and Transfections•Timing 3-4 d The CRISPR-Cas system has been used in a number of mammalian cell lines. Conditions may vary for each cell line. The protocols below details transfection conditions for HEK239FT cells. Note for ssODN-mediated HDR transfections, the Amaxa SF Cell Line Nucleofector Kit is used for optimal delivery of ssODNs. This is described in the next section.

7| HEK293FT maintenance. Cells are maintained according to the manufacturer's recommendations. Briefly, Applicants cultured cells in D10 medium (GlutaMax DMEM supplemented with 10% Fetal Bovine Serum), at 37° C. and 5% C02.

8| To passage, Applicants removed medium and rinsed once by gently adding DPBS to side of vessel, so as not to dislodge cells. Applicants added 2 ml of TrypLE to a T75 flask and incubated for 5 m at 37° C. 10 ml of warm D10 medium is added to inactivate and transferred to a 50 ml Falcon tube. Applicants dissociated cells by triturating gently, and re-seeded new flasks as necessary. Applicants typically passage cells every 2-3 d at a split ratio of 1:4 or 1:8, never allowing cells to reach more than 70% confluency. Cell lines are restarted upon reaching passage number 15.

9| Prepare cells for transfection. Applicants plated well-dissociated cells onto 24-well plates in D10 medium without antibiotics 16-24 h before transfection at a seeding density of $1.3 \times 10^5$ cells per well and a seeding volume of 500 ul. Scale up or down according to the manufacturer's manual as needed. It is suggested to not plate more cells than recommended density as doing so may reduce transfection efficiency.

10| On the day of transfection, cells are optimal at 70-90% confluency. Cells may be transfected with Lipofectamine 2000 or Amaxa SF Cell Line Nucleofector Kit according to the manufacturers' protocols.

(A) For sgRNAs cloned into PX330, Applicants transfected 500 ng of sequence-verified CRISPR plasmid; if transfecting more than one plasmid, mix at equimolar ratio and no more than 500 ng total.

(B) For sgRNA amplified by PCR, Applicants mixed the following:

| PX165 (Cas9 only) | 200 ng |
|---|---|
| sgRNA amplicon (each) | 40 ng |
| pUC19 | fill up total DNA to 500 ng |

Applicants recommend transfecting in technical triplicates for reliable quantification and including transfection controls (e.g. GFP plasmid) to monitor transfection efficiency. In addition, PX330 cloning plasmid and/or sgRNA amplicon may be transfected alone as a negative control for downstream functional assays.

11| Applicants added Lipofectamine complex to cells gently as HEK293FT cells may detach easily from plate easily and result in lower transfection efficiency.

12| Applicants checked cells 24 h after transfection for efficiency by estimating the fraction of fluorescent cells in the control (e.g., GFP) transfection using a fluorescence microscope. Typically cells are more than 70% transfected.

13| Applicants supplemented the culture medium with an additional 500 ul of warm D10 medium. Add D10 very slowly to the side of the well and do not use cold medium, as cells can detach easily.

14| Cells are incubated for a total of 48-72 h post-transfection before harvested for indel analysis. Indel efficiency does not increase noticeably after 48 h.
(Optional) Co-Transfection of CRISPR Plasmids and ssODNs or Targeting Plasmids for HR•Timing 3-4 d 15| Linearize targeting plasmid. Targeting vector is linearized if possible by cutting once at a restriction site in the vector backbone near one of the homology arms or at the distal end of either homology arm.

16| Applicants ran a small amount of the linearized plasmid alongside uncut plasmid on a 0.8-1% agarose gel to check successful linearization. Linearized plasmid should run above the supercoiled plasmid.

17| Applicants purified linearized plasmid with the QIA-Quick PCR Purification kit.

18| Prepare cells for transfection. Applicants cultured HEK293FT in T75 or T225 flasks. Sufficient cell count before day of transfection is planned for. For the Amaxa strip-cuvette format, $2 \times 10^6$ cells are used per transfection.

19| Prepare plates for transfection. Applicants added 1 ml of warm D10 medium into each well of a 12 well plate. Plates are placed into the incubator to keep medium warm.

20| Nucleofection. Applicants transfected HEK293FT cells according to the Amaxa SF Cell Line Nucleofector 4D Kit manufacturer's instructions, adapted in the steps below.

a. For ssODN and CRISPR cotransfection, pre-mix the following DNA in PCR tubes:

| pCRISPR plasmid (Cas9 + sgRNA) | 500 ng |
| ssODN template (10 uM) | 1 ul | b. For HDR targeting plasmid and CRISPR cotransfection, pre-mix the following DNA in PCR tubes:

| CRISPR plasmid (Cas9 + sgRNA) | 500 ng |
| Linearized targeting plasmid | 500 ng |

For transfection controls, see previous section. In addition, Applicants recommend transfecting ssODN or targeting plasmid alone as a negative control.

21| Dissociate to single cells. Applicants removed medium and rinsed once gently with DPBS, taking care not to dislodge cells. 2 ml of TrypLE is added to a T75 flask and incubated for 5 m at 37° C. 10 ml of warm D10 medium is added to inactivate and triturated gently in a 50 ml Falcon tube. It is recommended that cells are triturated gently and dissociated to single cells. Large clumps will reduce transfection efficiency. Applicants took a 10 ul aliquot from the suspension and diluted into 90 ul of D10 medium for counting. Applicants counted cells and calculated the number of cells and volume of suspension needed for transfection. Applicants typically transfected $2\times10^5$ cells per condition using the Amaxa Nucleocuvette strips, and recommend calculating for 20% more cells than required to adjust for volume loss in subsequent pipetting steps. The volume needed is transferred into a new Falcon tube.

23| Applicants spun down the new tube at 200× g for 5 m.

Applicants prepared the transfection solution by mixing the SF solution and S1 supplement as recommended by Amaxa. For Amaxa strip-cuvettes, a total of 20 ul of supplemented SF solution is needed per transfection. Likewise, Applicants recommend calculating for 20% more volume than required.

25| Applicants removed medium completely from pelleted cells from step 23 and gently resuspended in appropriate volume (20 ul per $2\times10^5$ cells) of S1-supplemented SF solution. Do not leave cells in SF solution for extended period of time.

26| 20 ul of resuspended cells is pipetted into each DNA pre-mix from step 20. Pipette gently to mix and transfer to Nucleocuvette strip chamber. This is repeated for each transfection condition.

Electroporate cells using the Nucleofector 4D program recommended by Amaxa, CM-130.

28| Applicants gently and slowly pipetted 100 ul of warm D10 medium into each Nucleocuvette strip chamber, and transferred all volume into the pre-warmed plate from step 19. CRITICAL. Cells are very fragile at this stage and harsh pipetting can cause cell death. Incubate for 24 h. At this point, transfection efficiency can be estimated from fraction of fluorescent cells in positive transfection control. Nucleofection typically results in greater than 70-80% transfection efficiency. Applicants slowly added 1 ml warm D10 medium to each well without dislodging the cells. Incubate cells for a total of 72 h.

Human Embryonic Stem Cell (HUES 9) Culture and Transfection•Timing 3-4 d

Maintaining hESC (HUES9) line. Applicants routinely maintain HUES9 cell line in feeder-free conditions with mTesR1 medium. Applicants prepared mTeSR1 medium by adding the 5× supplement included with basal medium and 100 μg/ml Normocin. Applicants prepared a 10 ml aliquot of mTeSR1 medium supplemented further with 10 uM Rock Inhibitor. Coat tissue culture plate. Dilute cold GelTrex 1:100 in cold DMEM and coat the entire surface of a 100 mm tissue culture plate.

Place plate in incubator for at least 30 m at 37° C. Thaw out a vial of cells at 37° C. in a 15 ml Falcon tube, add 5 ml of mTeSR1 medium, and pellet at 200× g for 5 m. Aspirate off GelTrex coating and seed ~1×106 cells with 10 ml mTeSR1 medium containing Rock Inhibitor. Change to normal mTeSR1 medium 24 h after transfection and re-feed daily. Passaging cells. Re-feed cells with fresh mTeSR1 medium daily and passage before reaching 70% confluency. Aspirate off mTeSR1 medium and wash cells once with DPBS. Dissociate cells by adding 2 ml Accutase and incubating at 37° C. for 3-5 m. Add 10 ml mTeSR1 medium to detached cells, transfer to 15 ml Falcon tube and resuspend gently. Re-plate onto GelTrex-coated plates in mTeSR1 medium with 10 uM Rock Inhibitor. Change to normal mTeSR1 medium 24 h after plating.

Transfection. Applicants recommend culturing cells for at least 1 week post-thaw before transfecting using the Amaxa P3 Primary Cell 4-D Nucleofector Kit (Lonza). Re-feed log-phase growing cells with fresh medium 2 h before transfection. Dissociate to single cells or small clusters of no more than 10 cells with accutase and gentle resuspension. Count the number of cells needed for nucleofection and spin down at 200× g for 5 m. Remove medium completely and resuspend in recommended volume of S1-supplemented P3 nucleofection solution. Gently plate electroporated cells into coated plates in presence of 1× Rock Inhibitor.

Check transfection success and re-feed daily with regular mTeSR1 medium beginning 24 h after nucleofection. Typically, Applicants observe greater than 70% transfection efficiency with Amaxa Nucleofection. Harvest DNA. 48-72 h post transfection, dissociate cells using accutase and inactivate by adding 5× volume of mTeSR1. Spin cells down at 200× g for 5 m. Pelleted cells can be directed processed for DNA extraction with QuickExtract solution. It is recommended to not mechanically dissociate cells without accutase. It is recommended to not spin cells down without inactivating accutase or above the recommended speed; doing so may cause cells to lyse.

Isolation of Clonal Cell Lines by FACS. Timing•2-3 h Hands-on; 2-3 Weeks Expansion Clonal isolation may be performed 24 h post-transfection by FACS or by serial dilution.

54| Prepare FACS buffer. Cells that do not need sorting using colored fluorescence may be sorted in regular D10 medium supplemented with 1× penicillin/streptinomycin. If colored fluorescence sorting is also required, a phenol-free DMEM or DPBS is substituted for normal DMEM. Supplement with 1× penicillin/streptinomycin and filter through a 0.22 um Steriflip filter.

55| Prepare 96 wellplates. Applicants added 100 ul of D10 media supplemented with 1× penicillin/streptinomycin per well and prepared the number of plates as needed for the desired number of clones.

56| Prepare cells for FACS. Applicants dissociated cells by aspirating the medium completely and adding 100 ul TrypLE per well of a 24-well plate. Incubate for 5 m and add 400 ul warm D10 media.

57| Resuspended cells are transferred into a 15 ml Falcon tube and gently triturated 20 times. Recommended to check under the microscope to ensure dissociation to single cells.

58| Spin down cells at 200× g for 5 minutes.

59| Applicants aspirated the media, and resuspended the cells in 200 ul of FACS media.

60| Cells are filtered through a 35 um mesh filter into labeled FACS tubes. Applicants recommend using the BD Falcon 12×75 mm Tube with Cell Strainer cap. Place cells on ice until sorting.

61| Applicants sorted single cells into 96-well plates prepared from step 55. Applicants recommend that in one single designated well on each plate, sort 100 cells as a positive control.

NOTE. The remainder of the cells may be kept and used for genotyping at the population level to gauge overall modification efficiency.

62| Applicants returned cells into the incubator and allowed them to expand for 2-3 weeks. 100 ul of warm D10 medium is added 5 d post sorting. Change 100 ul of medium every 3-5 d as necessary.

63| Colonies are inspected for "clonal" appearance 1 week post sorting: rounded colonies radiating from a central point. Mark off wells that are empty or may have been seeded with doublets or multiplets.

64| When cells are more than 60% confluent, Applicants prepared a set of replica plates for passaging. 100 ul of D10 medium is added to each well in the replica plates. Applicants dissociated cells directly by pipetting up and down vigorously 20 times. 20% of the resuspended volume was plated into the prepared replica plates to keep the clonal lines. Change the medium every 2-3 d thereafter and passage accordingly.

65| Use the remainder 80% of cells for DNA isolation and genotyping.

Optional: Isolation of Clonal Cell Lines by Dilution. Timing•2-3 h Hands-on; 2-3 Weeks Expansion 66| Applicants dissociated cells from 24-well plates as described above. Make sure to dissociate to single cells. A cell strainer can be used to prevent clumping of cells.

67| The number of cells are counted in each condition. Serially dilute each condition in D10 medium to a final concentration of 0.5 cells per 100 ul. For each 96 well plate, Applicants recommend diluting to a final count of 60 cells in 12 ml of D10. Accurate count of cell number is recommended for appropriate clonal dilution. Cells may be recounted at an intermediate serial dilution stage to ensure accuracy.

68| Multichannel pipette was used to pipette 100 ul of diluted cells to each well of a 96 well plate.

NOTE. The remainder of the cells may be kept and used for genotyping at the population level to gauge overall modification efficiency.

69| Applicants inspected colonies for "clonal" appearance ~1 week post plating: rounded colonies radiating from a central point. Mark off wells that may have seeded with doublets or multiplets.

70| Applicants returned cells to the incubator and allowed them to expand for 2-3 weeks. Re-feed cells as needed as detailed in previous section.

SURVEYOR Assay for CRISPR Cleavage Efficiency. Timing•5-6 h

Before assaying cleavage efficiency of transfected cells, Applicants recommend testing each new SURVEYOR primer on negative (untransfected) control samples through the step of SURVEYOR nuclease digestion using the protocol described below. Occasionally, even single-band clean SURVEYOR PCR products can yield non-specific SURVEYOR nuclease cleavage bands and potentially interfere with accurate indel analysis.

71| Harvest cellsfor DNA. Dissociate cells and spin down at 200× g for 5 m. NOTE. Replica plate at this stage as needed to keep transfected cell lines.

72| Aspirate the supernatant completely.

73| Applicants used QuickExtract DNA extraction solution according to the manufacturer's instructions. Applicants typically used 50 ul of the solution for each well of a 24 well plate and 10 ul for a 96 well plate.

74| Applicants normalized extracted DNA to a final concentration of 100-200 ng/ul with ddH2O. Pause point: Extracted DNA may be stored at −20° C. for several months.

75| Set up the SURVEYOR PCR. Master mix the following using SURVEYOR primers provided by Applicants online/computer algorithm tool:

TABLE 13

| Component: | Amount (ul) | Final concentration |
|---|---|---|
| Herculase II PCR buffer, 5X | 10 | 1X |
| dNTP, 100 mM (25 mM each) | 1 | 1 mM |
| SURVEYOR Fwd primer (10 uM) | 1 | 0.2 uM |
| SURVEYOR Rev primer (10 uM) | 1 | 0.2 uM |
| Herculase II Fusion polymerase | 1 | |
| MgCl$_2$ (25 mM) | 2 | 1 mM |
| Distilled water | | 33 |
| Total | 49 (for each reaction) | |

76| Applicants added 100-200 ng of normalized genomic DNA template from step 74 for each reaction.

77| PCR reaction was performed using the following cycling conditions, for no more than 30 amplification cycles: Table 14.

TABLE 14

| Cycle number | Denature | Anneal | Extend |
|---|---|---|---|
| 1 | 95° C., 2 min | | |
| 2-31 | 95° C., 20 s | 60° C., 20 s | 72° C., 30 s |
| 32 | | | 72° C., 3 min |

78| Applicants ran 2-5 ul of PCR product on a 1% gel to check for single-band product. Although these PCR conditions are designed to work with most pairs of SURVEYOR primers, some primers may need additional optimization by adjusting the template concentration, MgCl$_2$ concentration, and/or the annealing temperature.

79| Applicants purified the PCR reactions using the QIAQuick PCR purification kit and normalized eluant to 20 ng/ul. Pause point: Purified PCR product may be stored at −20° C.

80| DNA heteroduplex formation. The annealing reaction was set up as follows:

TABLE 15

| | |
|---|---|
| Taq PCR buffer, 10X | 2 ul |
| Normalized DNA (20 ng/ul) | 18 ul |
| Total volume | 20 ul |

81| Anneal the reaction using the following conditions:

TABLE 16

| Cycle number | Condition |
|---|---|
| 1 | 95° C., 10 min |
| 2 | 95° C.-85° C., −2° C./s |
| 3 | 85° C., 1 min |
| 4 | 85° C.-75° C., −0.3° C./s |
| 5 | 75° C., 1 min |
| 6 | 75° C.-65° C., −0.3° C./s |
| 7 | 65° C., 1 min |
| 8 | 65° C.-55° C., −0.3° C./s |
| 9 | 55° C., 1 min |
| 10 | 55° C.-45° C., −0.3° C./s |
| 11 | 45° C., 1 min |
| 12 | 45° C.-35° C., −0.3° C./s |
| 13 | 35° C., 1 min |
| 14 | 35° C.-25° C., −0.3° C./s |
| 15 | 25° C., 1 min |

82| SURVEYOR nuclease S digestion. Applicants prepared master-mix and added the following components on ice to annealed heteroduplexes from step 81 for a total final volume of 25 ul:

TABLE 17

| Component | Amount (ul) | Final Concentration |
|---|---|---|
| MgCl$_2$ solution, 0.15 M | 2.5 | 15 mM |
| ddH$_2$O | 0.5 | |
| SURVEYOR nuclease S | 1 | 1X |
| SURVEYOR enhancer S | 1 | 1X |
| Total | 5 | |

83| Vortex well and spin down. Incubate the reaction at 42° C. for 1 h.

84| Optional: 2 ul of the Stop Solution from the SURVEYOR kit may be added. Pause point. The digested product may be stored at −20° C. for analysis at a later time.

85| Visualize the SURVEYOR reaction. SURVEYOR nuclease digestion products may be visualized on a 2% agarose gel. For better resolution, products may be run on a 4-20% gradient Polyacrylamide TBE gel. Applicants loaded 10 ul of product with the recommended loading buffer and ran the gel according to manufacturer's instructions. Typically, Applicants run until the bromophenol blue dye has migrated to the bottom of the gel. Include DNA ladder and negative controls on the same gel.

86| Applicants stained the gel with 1× SYBR Gold dye diluted in TBE. The gel was gently rocked for 15 m.

87| Applicants imaged the gel using a quantitative imaging system without overexposing the bands. The negative controls should have only one band corresponding to the size of the PCR product, but may have occasionally non-specific cleavage bands of other sizes. These will not interfere with analysis if they are different in size from target cleavage bands. The sum of target cleavage band sizes, provided by Applicants online/computer algorithm tool, should be equal to the size of the PCR product.

88| Estimate the cleavage intensity. Applicants quantified the integrated intensity of each band using ImageJ or other gel quantification software.

89| For each lane, Applicants calculated the fraction of the PCR product cleaved ($f_{cut}$) using the following formula: $f_{cut}$=(b+c)/(a+b+c), where a is the integrated intensity of the undigested PCR product and b and c are the integrated intensities of each cleavage product. 90| Cleavage efficiency may be estimated using the following formula, based on the binomial probability distribution of duplex formation:

91| indel (%)=100× (1−$\sqrt{(1-f_{cut})}$)|IPSpecs_L1|ZZMPTAG|

Sanger Sequencing for Assessing CRISPR Cleavage Efficiency. Timing•3 d

Initial steps are identical to Steps 71-79 of the SURVEYOR assay. Note: SURVEYOR primers may be used for Sanger sequencing if appropriate restriction sites are appended to the Forward and Reverse primers. For cloning into the recommended pUC19 backbone, EcoRI may be used for the Fwd primer and HindIII for the Rev primer.

92| Amplicon digestion. Set up the digestion reaction as follows:

TABLE 18

| Component | Amount (ul) |
|---|---|
| Fast Digest buffer, 10X | 3 |
| FastDigest EcoRI | 1 |
| FastDigest HindIII | 1 |
| Normalized DNA (20 ng/ul) | 10 |
| ddH$_2$O | 15 |
| Total volume | 30 |

93| pUC19 backbone digestion. Set up the digestion reaction as follows:

TABLE 19

| Component | Amount (ul) |
|---|---|
| Fast Digest buffer, 10X | 3 |
| FastDigest EcoRI | 1 |
| FastDigest HindIII | 1 |
| FastAP Alkaline Phosphatase | 1 |
| pUC19 vector (200 ng/ul) | 5 |
| ddH$_2$O | 20 |
| Total volume | 30 |

94| Applicants purified the digestion reactions using the QIAQuick PCR purification kit. Pause point: Purified PCR product may be stored at −20° C.

95| Applicants ligated the digested pUC19 backbone and Sanger amplicons at a 1:3 vector:insert ratio as follows:

TABLE 20

| Component | Amount (ul) |
| --- | --- |
| Digested pUC19 | x (50 ng) |
| Digested insert | x (1:3 vector:insert molar ratio) |
| T7 ligase | 1 |
| 2X Rapid Ligation Buffer | 10 |
| ddH$_2$O | x |
| Total volume | 20 |

96| Transformation. Applicants transformed the Plasmid-Safe-treated plasmid into a competent *E. coli* strain, according to the protocol supplied with the cells. Applicants recommend Stbl3 for quick transformation. Briefly, 5 ul of the product from step 95 is added into 20 ul of ice-cold chemically competent Stbl3 cells, incubated on ice for 10 m, heat shocked at 42° C. for 30 s, returned immediately to ice for 2 m, 100 ul of SOC medium is added, and plated onto an LB plate containing 100 μg/ml ampicillin. This is incubated overnight at 37° C.

97| Day 2: Applicants inspected plates for colony growth. Typically, there are no colonies on the negative control plates (ligation of EcoRI-HindIII digested pUC19 only, no Sanger amplicon insert), and tens to hundreds of colonies on the pUC19-Sanger amplicon cloning plates.

98| Day 3: Applicants isolated plasmid DNA from overnight cultures using a QIAprep Spin miniprep kit according to the manufacturer's instructions.

99| Sanger sequencing. Applicants verified the sequence of each colony by sequencing from the pUC19 backbone using the pUC19-For primer. Applicants referenced the sequencing results against the expected genomic DNA sequence to check for the presence of Cas9-induced NHEJ mutations. % editing efficiency=(# modified clones)/(# total clones). It is important to pick a reasonable number of clones (>24) to generate accurate modification efficiencies.

Genotyping for Microdeletion. Timing•2-3 d Hands on; 2-3 Weeks Expansion

100| Cells were transfected as described above with a pair of sgRNAs targeting the region to be deleted.

101| 24 h post-transfection, clonal lines are isolated by FACS or serial dilution as described above.

102| Cells are expanded for 2-3 weeks.

103| Applicants harvested DNA from clonal lines as described above using 10 ul QuickExtract solution and normalized genomic DNA with ddH$_2$O to a final concentration of 50-100 ng/ul.

104| PCR Amplify the modified region. The PCR reaction is set up as follows:

TABLE 21

| Component: | Amount (ul) | Final concentration |
| --- | --- | --- |
| Herculase II PCR buffer, 5X | 10 | 1X |
| dNTP, 100 mM (25 mM each) | 1 | 1 mM |
| Out Fwd primer (10 uM) | 1 | 0.2 uM |

TABLE 21-continued

| Component: | Amount (ul) | Final concentration |
| --- | --- | --- |
| Out Rev primer (10 uM) | 1 | 0.2 uM |
| Herculase II Fusion polymerase | 1 | |
| MgCl2 (25 mM) | 2 | 1 mM |
| ddH$_2$O | 32 | |
| Total | 48 | |
| | (for each reaction) | |

Note: if deletion size is more than 1 kb, set up a parallel set of PCR reactions with In-Fwd and In-Rev primers to screen for the presence of the wt allele.

105| To screen for inversions, a PCR reaction is set up as follows:

TABLE 22

| Component: | Amount (ul) | Final concentration |
| --- | --- | --- |
| Herculase II PCR buffer, 5X | 10 | 1X |
| dNTP, 100 mM (25 mM each) | 1 | 1 mM |
| Out Fwd or Out-Rev primer (10 uM) | 1 | 0.2 uM |
| In Fwd or In-Rev primer (10 uM) | 1 | 0.2 uM |
| Herculase II Fusion polymerase | 1 | |
| MgCl$_2$ (25 mM) | 2 | 1 mM |
| ddH$_2$O | 32 | |
| Total | 48 | |
| | (for each reaction) | |

Note: primers are paired either as Out-Fwd+In Fwd, or Out-Rev+In-Rev.

106| Applicants added 100-200 ng of normalized genomic DNA template from step 103 for each reaction.

107| PCR reaction was performed using the following cycling conditions: Table 23. Cycle number Denature Anneal Extend

TABLE 23

| Cycle number | Denature | Anneal | Extend |
| --- | --- | --- | --- |
| 1 | 95° C., 2 min | | |
| 2-31 | 95° C., 20 s | 60° C., 20 s | 72° C., 30 s |
| 32 | 72° C., 3 m | | |

108| Applicants run 2-5 ul of PCR product on a 1-2% gel to check for product. Although these PCR conditions are designed to work with most primers, some primers may need additional optimization by adjusting the template concentration, MgCl$_2$ concentration, and/or the annealing temperature.

Genotyping for Targeted Modifications Via HDR. Timing•2-3 d, 2-3 h Hands on

109| Applicants harvested DNA as described above using QuickExtract solution and normalized genomic DNA with TE to a final concentration of 100-200 ng/ul.

110| PCR Amplify the modified region. The PCR reaction is set up as follows:

TABLE 24

| Component: | Amount (ul) | Final concentration |
|---|---|---|
| Herculase II PCR buffer, 5X | 10 | 1X |
| dNTP, 100 mM (25 mM each) | 1 | 1 mM |
| HDR Fwd primer (10 uM) | 1 | 0.2 uM |
| HDR Rev primer (10 uM) | 1 | 0.2 uM |
| Herculase II Fusion polymerase | 1 | |
| MgCl$_2$ (25 mM) | 2 | 1 mM |
| ddH$_2$O | 33 | |
| Total | 49 (for each reaction) | |

111| Applicants added 100-200 ng of genomic DNA template from step 109 for each reaction and run the following program, Table 25.

TABLE 25

| Cycle number | Denature | Anneal | Extend |
|---|---|---|---|
| 1 | 95° C., 2 min | | |
| 2-31 | 95° C., 20 s | 60° C., 20 s | 72° C., 30-60 s per kb |
| 32 | | | 72° C., 3 min |

112| Applicants ran 5 ul of PCR product on a 0.8-1% gel to check for single-band product. Primers may need additional optimization by adjusting the template concentration, MgCl$_2$ concentration, and/or the annealing temperature.

113| Applicants purified the PCR reactions using the QIAQuick PCR purification kit.

114| In the HDR example, a HindIII restriction site is inserted into the EMX1 gene. These are detected by a restriction digest of the PCR amplicon: Table 26.

TABLE 26

| Component | Amount (ul) |
|---|---|
| Purified PCR amplicon (200-300 ng) | x |
| F.D. buffer, Green | 1 |
| HindIII | 0.5 |
| ddH2O | x |
| Total | 10 | i. The DNA is digested for 10 m at 37° C.:
ii. Applicants ran 10 ul of the digested product with loading dye on a 4-20% gradient polyacrylamide TBE gel until the xylene cyanol band had migrated to the bottom of the gel.
iii. Applicants stained the gel with 1× SYBR Gold dye while rocking for 15 m.
iv. The cleavage products are imaged and quantified as described above in the SURVEYOR assay section. HDR efficiency is estimated by the formula: (b+c)/(a+b+c), where a is the integrated intensity for the undigested HDR PCR product, and b and c are the integrated intensities for the HindIII-cut fragments.

115| Alternatively, purified PCR amplicons from step 113 may be cloned and genotyped using Sanger sequencing or NGS.

Deep Sequencing and Off-Target Analysis•Timing 1-2 d

The online CRISPR target design tool generates candidate genomic off-target sites for each identified target site. Off-target analysis at these sites can be performed by SURVEYOR nuclease assay, Sanger sequencing, or next-generation deep sequencing. Given the likelihood of low or undetectable modification rates at many of these sites, Applicants recommend deep sequencing with the Illumina Miseq platform for high sensitivity and accuracy. Protocols will vary with sequencing platform; here, Applicants briefly describe a fusion PCR method for attaching sequencing adapters.

116| Design deep sequencingprimers. Next-generation sequencing (NGS) primers are designed for shorter amplicons, typically in the 100-200 bp size range. Primers may be manually designed using NCBI Primer-Blast or generated with online CRISPR target design tools (website at genome-engineering.org/tools).

117| Harvest genomic DNA from Cas9-targeted cells. Normalize QuickExtract genomic DNA to 100-200 ng/ul with ddH2O.

118| Initial library preparation PCR. Using the NGS primers from step 116, prepare the initial library preparation PCR.

TABLE 27

| Component: | Amount (ul) | Final concentration |
|---|---|---|
| Herculase II PCR buffer, 5X | 10 | 1X |
| dNTP, 100 mM (25 mM each) | 1 | 1 mM |
| NGS Fwd primer (10 uM) | 1 | 0.2 uM |
| NGS Rev primer (10 uM) | 1 | 0.2 uM |
| Herculase II Fusion polymerase | 1 | |
| MgCl2 (25 mM) | 2 | 1 mM |
| ddH2O | 33 | |
| Total | 49 (for each reaction) | |

119| Add 100-200 ng of normalized genomic DNA template for each reaction.

120| Perform PCR reaction using the following cycling conditions, for no more than 20 amplification cycles:

TABLE 28

| Cycle number | Denature | Anneal | Extend |
|---|---|---|---|
| 1 | 95° C., 2 min | | |
| 2-21 | 95° C., 20 s | 60° C., 20 s | 72° C., 15 s |
| 22 | | | 72° C., 3 min |

121| Run 2-5 ul of PCR product on a 1% gel to check for single-band product. As with all genomic DNA PCRs, NGS primers may require additional optimization by adjusting the template concentration, MgCl$_2$ concentration, and/or the annealing temperature.

122| Purify the PCR reactions using the QIAQuick PCR purification kit and normalize eluant to 20 ng/ul. Pause point: Purified PCR product may be stored at −20° C.

123| Nextera XT DNA Sample Preparation Kit. Following the manufacturer's protocol, generate Miseq sequencing-ready libraries with unique barcodes for each sample.

124| Analyze sequencing data. Off-target analysis may be performed through read alignment programs such as ClustalW, Geneious, or simple sequence analysis scripts.

Timing

Steps 1-2 Design and synthesis of sgRNA oligos and ssODNs: 1-5 d, variable depending on supplier Steps 3-5 Construction of CRISPR plasmid or PCR expression cassette: 2 h to 3 d Steps 6-53 Transfection into cell lines: 3 d (1 h hands-on time)

Steps 54-70 Optional derivation of clonal lines: 1-3 weeks, variable depending on cell type Steps 71-91 Functional validation of NHEJ via SURVEYOR: 5-6 h Steps 92-124 Genotyping via Sanger or next-gen deep sequencing: 2-3 d (3-4 h hands on time) Table 29.

Addressing Situations Concerning Herein Examples

| Situation | Solution |
| --- | --- |
| No amplification of sgRNA | Titrate U6-template concentration |
| SURVEYOR or HDR PCR dirty or no amplification | Titrate MgCl2; normalize and titrate template concentration; annealing temp gradient; redesign primers |
| Unequal amplification of alleles in microdeletion PCRs | Set up separate PCRs to detect wildtype and deletion alleles; Redesign primers with similar sized amplicons |
| Colonies on negative control plate | Increase BbsI; increase Golden Gate reaction cycle number, cut PX330 separately with Antarctic Phosphate treatment |
| No sgRNA sequences or wrong sequences | Screen additional colonies |
| Low lipofectamine transfection efficiency | Check cell health and density; titrate DNA; add GFP transfection control |
| Low nucleofection transfection efficiency | Check cell health and density; titrate DNA; suspend to single cell |
| Clumps or no cells after FACS | Filter cells before FACS; dissociate to single cells; resuspend in appropriate density |
| Clumps or no cells in serial dilution | Recount cells; dissociate to single cells and filter through strainer; check serial dilution |
| High SURVEYOR background on negative sample | Redesign primers to prime from different locations |
| Dirty SURVEYOR result on gel | Purify PCR product; reduce input DNA; reduce 42° C. incubation to 30 m |
| No SURVEYOR cleavage | Purify and normalize PCR product; re-anneal with TaqB buffer; Redesign sgRNAs; sequence verify Cas9 on px330 backbone |
| Samples do not sink in TBE acrylamide gel | Supplement with MgCl2 to a final concentration of 15 mM or add loading buffer containing glycerol |

Discussion

Figure 30A:
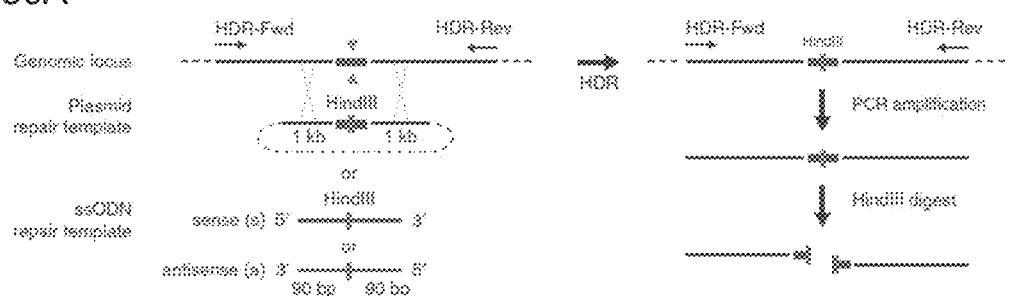
FIG. 30A-C shows anticipated results for HDR in HEK and HUES9 cells. (a) Either a targeting plasmid or an ssODN (sense or antisense) with homology arms can be used to edit the sequence at a target genomic locus cleaved by Cas9 (red triangle). To assay the efficiency of HDR, Applicants introduced a HindIII site (red bar) into the target locus, which was PCR-amplified with primers that anneal outside of the region of homology. Digestion of the PCR product with HindIII reveals the occurrence of HDR events. (b) ssODNs, oriented in either the sense or the antisense (s or a) direction relative to the locus of interest, can be used in combination with Cas9 to achieve efficient HDR-mediated editing at the target locus. A minimal homology region of 40 bp, and preferably 90 bp, is recommended on either side of the modification (red bar). (c) Example of the effect of ssODNs on HDR in the EMX1 locus is shown using both wild-type Cas9 and Cas9 nickase (D10A). Each ssODN contains homology arms of 90 bp flanking a 12-bp insertion of two restriction sites.
Figure 30B:
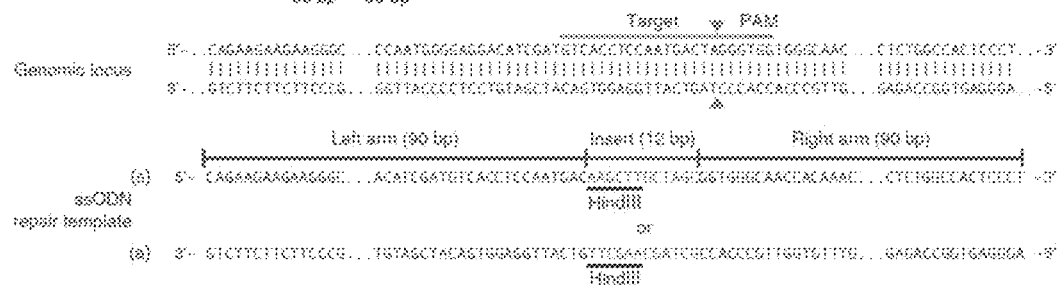
Figure 30C:
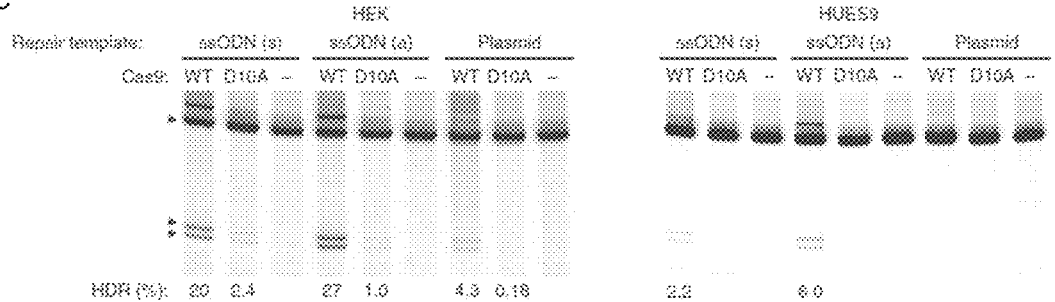

CRISPR-Cas may be easily multiplexed to facilitate simultaneous modification of several genes and mediate chromosomal microdeletions at high efficiencies. Applicants used two sgRNAs to demonstrate simultaneous targeting of the human GRIN2B and DYRK1A loci at efficiencies of up to 68% in HEK293FT cells. Likewise, a pair of sgRNAs may be used to mediate microdeletions, such as excision of an exon, which can be genotyped by PCR on a clonal level. Note that the precise location of exon junctions can vary. Applicants also demonstrated the use of ssODNs and targeting vector to mediate HDR with both wildtype and nickase mutant of Cas9 in HEK 293FT and HUES9 cells (FIG. 30). Note that Applicants have not been able to detect HDR in HUES9 cells using the Cas9 nickase, which may be due to low efficiency or a potential difference in repair activities in HUES9 cells. Although these values are typical, there is some variability in the cleavage efficiency of a given sgRNA, and on rare occasions certain sgRNAs may not work for reasons yet unknown. Applicants recommend designing two sgRNAs for each locus, and testing their efficiencies in the intended cell type.

Example 24: NLSs

Cas9 Transcriptional Modulator: Applicants set out to turn the Cas9/gRNA CRISPR system into a generalized DNA binding system in which functions beyond DNA cleavage can be executed. For instance, by fusing functional domain(s) onto a catalytically inactive Cas9 Applicants have imparted novel functions, such as transcriptional activation/repression, methylation/demethylation, or chromatin modifications. To accomplish this goal Applicants made a catalytically inactive Cas9 mutant by changing two residues essential for nuclease activity, D10 and H840, to alanine. By mutating these two residues the nuclease activity of Cas9 is abolished while maintaining the ability to bind target DNA. The functional domains Applicants decided to focus on to test Applicants' hypothesis are the transcriptional activator VP64 and the transcriptional repressors SID and KRAB.

Cas9 Nuclear localization: Applicants hypothesized that the most effective Cas9 transcriptional modulator would be strongly localized to the nucleus where it would have its greatest influence on transcription. Moreover, any residual Cas9 in the cytoplasm could have unwanted effects. Applicants determined that wild-type Cas9 does not localize into the nucleus without including multiple nuclear localization signals (NLSs) (although a CRISPR system need not have one or more NLSs but advantageously has at least one or more NLS(s)). Because multiple NLS sequences were required it was reasoned that it is difficult to get Cas9 into the nucleus and any additional domain that is fused to Cas9 could disrupt the nuclear localization. Therefore, Applicants made four Cas9-VP64-GFP fusion constructs with different NLS sequences (pXRP02-pLenti2-EF1a-NLS-hSpCsn1 (10A,840A)-NLS-VP64-EGFP, pXRP04-pLenti2-EF1a-NLS-hSpCsn1(10A,840A)-NLS-VP64-2A-EGFP-NLS, pXRP06-pLenti2-EF1a-NLS-EGFP-VP64-NLS-hSpCsn1

(10A,840A)-NLS, pXRP08-pLenti2-EF1a-NLS-VP64-NLS-hSpCsn1(10A,840A)-NLS-VP64-EGFP-NLS). These constructs were cloned into a lenti backbone under the expression of the human EF1α promoter. The WPRE element was also added for more robust protein expression. Each construct was transfected into HEK 293FT cells using Lipofectame 2000 and imaged 24 hours post-transfection. The best nuclear localization is obtained when the fusion proteins have NLS sequences on both the N- and C-term of the fusion protein. The highest observed nuclear localization occurred in the construct with four NLS elements.

To more robustly understand the influence of NLS elements on Cas9 Applicants made 16 Cas9-GFP fusions by adding the same alpha importin NLS sequence on either the N- or C-term looking at zero to three tandem repeats. Each construct was transfected into HEK 293FT cells using Lipofectame 2000 and imaged 24 hours post-transfection. Notably, the number of NLS elements does not directly correlate with the extent of nuclear localization. Adding an NLS on the C-term has a greater influence on nuclear localization than adding on the N-term.

Cas9 Transcriptional Activator: Applicants functionally tested the Cas9-VP64 protein by targeting the Sox2 locus and quantifying transcriptional activation by RT-qPCR. Eight DNA target sites were chosen to span the promoter of Sox2. Each construct was transfected into HEK 293FT cells using Lipofectame 2000 and 72 hours post-transfection total RNA was extracted from the cells. 1 µg of RNA was reverse transcribed into cDNA (qScript Supermix) in a 40 ul reaction. 2 ul of reaction product was added into a single 20 ul TaqMan assay qPCR reaction. Each experiment was performed in biological and technical triplicates. No RT control and no template control reactions showed no amplification. Constructs that do not show strong nuclear localization, pXRP02 and pXRP04, result in no activation. For the construct that did show strong nuclear localization, pXRP08, moderate activation was observed. Statistically significant activation was observed in the case of guide RNAs Sox2.4 and Sox2.5.

Example 25: In Vivo Mouse Data

Material and Reagents
Herculase II fusion polymerase (Agilent Technologies, cat. no. 600679)
10× NEBuffer 4 (NEB, cat. No. B7004S)
BsaI HF (NEB, cat. No. R3535S)
T7 DNA ligase (Enzymatics, cat. no. L602L)
Fast Digest buffer, 10× (ThermoScientific, cat. No. B64)
FastDigest NotI (ThermoScientific, cat. No. FD0594)
FastAP Alkaline Phosphatase (ThermoScientific, cat. No. EF0651)
Lipofectamine2000 (Life Technologies, cat. No. 11668-019)
Trypsin (Life Technologies, cat. No. 15400054)
Forceps #4 (Sigma, cat. No. Z168777-1EA)
Forceps #5 (Sigma, cat. No. F6521-1EA)
10× Hank's Balanced Salt Solution (Sigma, cat. No. H4641-500 ML)
Penicillin/Streptomycin solution (Life Technologies, cat. No. P4333)
Neurobasal (Life Technologies, cat. No. 21103049)
B27 Supplement (Life Technologies, cat. No. 17504044)
L-glutamine (Life Technologies, cat. No. 25030081)
Glutamate (Sigma, cat. No. RES5063G-A7)
β-mercaptoethanol (Sigma, cat. No. M6250-100 ML)
HA rabbit antibody (Cell Signaling, cat. No. 3724S)
LIVE/DEAD® Cell Imaging Kit (Life Technologies, cat. No. R37601)
30G World Precision Instrument syringe (World Precision Instruments, cat. No. NANOFIL)
Stereotaxic apparatus (Kopf Instruments)
UltraMicroPump3 (World Precision Instruments, cat. No. UMP3-4)
Sucrose (Sigma, cat. No. S7903)
Calcium chloride (Sigma, cat. No. C1016)
Magnesium acetate (Sigma, cat. No. M0631)
Tris-HCl (Sigma, cat. no T5941)
EDTA (Sigma, cat. No. E6758)
NP-40 (Sigma, cat. No. NP40)
Phenylmethanesulfonyl fluoride (Sigma, cat. No. 78830)
Magnesium chloride (Sigma, cat. No. M8266)
Potassium chloride (Sigma, cat. No. P9333)
β-glycerophosphate (Sigma, cat. No. G9422)
Glycerol (Sigma, cat. No. G9012)
Vybrant® DyeCycle™ Ruby Stain (Life technologies, cat. No. S4942)
FACS Aria Flu-act-cell sorter (Koch Institute of MIT, Cambridge US)
DNAeasy Blood & Tissue Kit (Qiagen, cat. No. 69504)

Procedure

Constructing gRNA Multiplexes for Using In Vivo in the Brain

Figure 33:
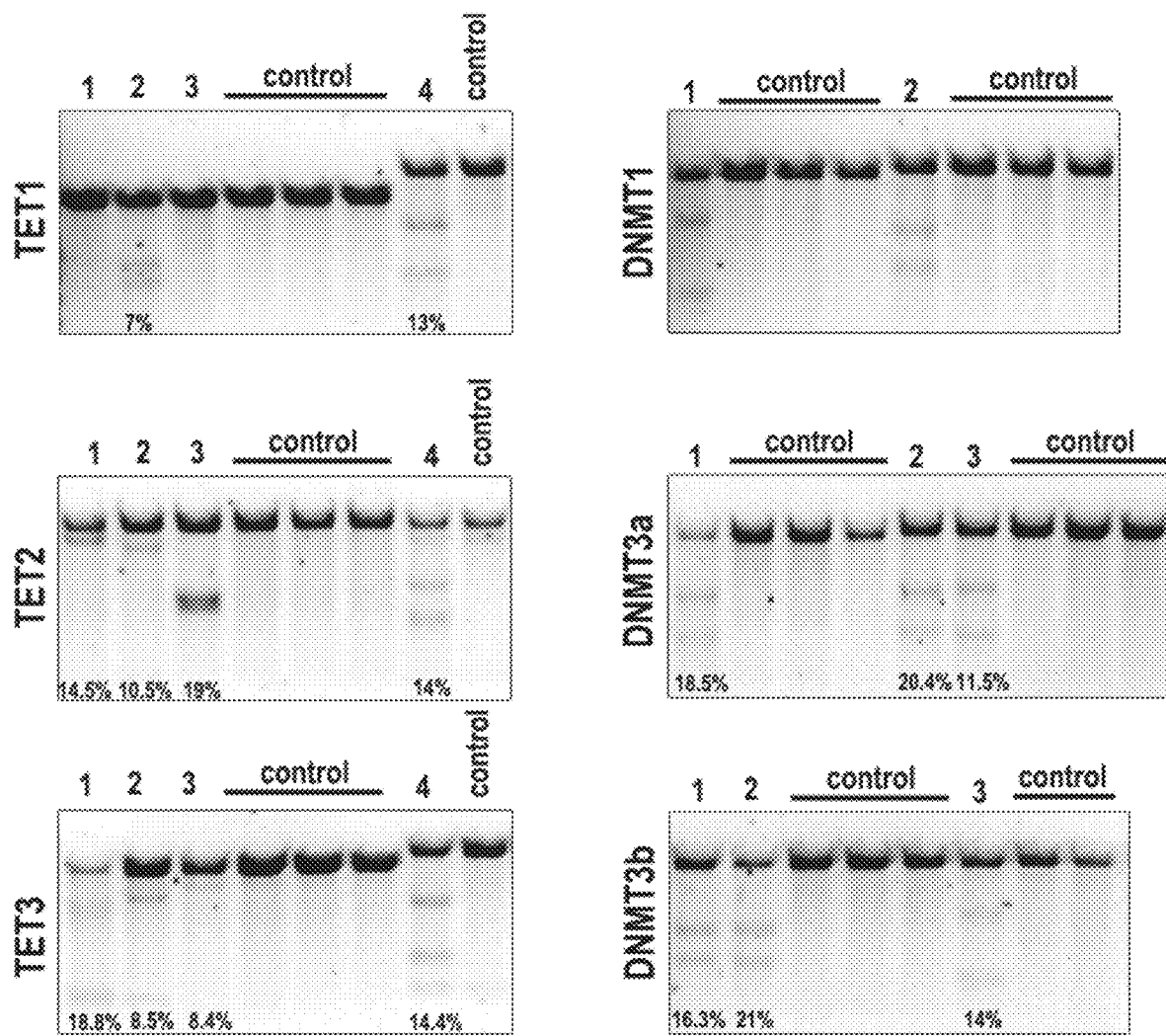
FIG. 33 shows a screen for efficient SpCas9 mediated targeting of Tet1-3 and Dnmt1, 3a and 3b gene loci. Surveyor assay on DNA from transfected N2A cells demonstrates efficient DNA cleavage by using different gRNAs.
Figure 34:
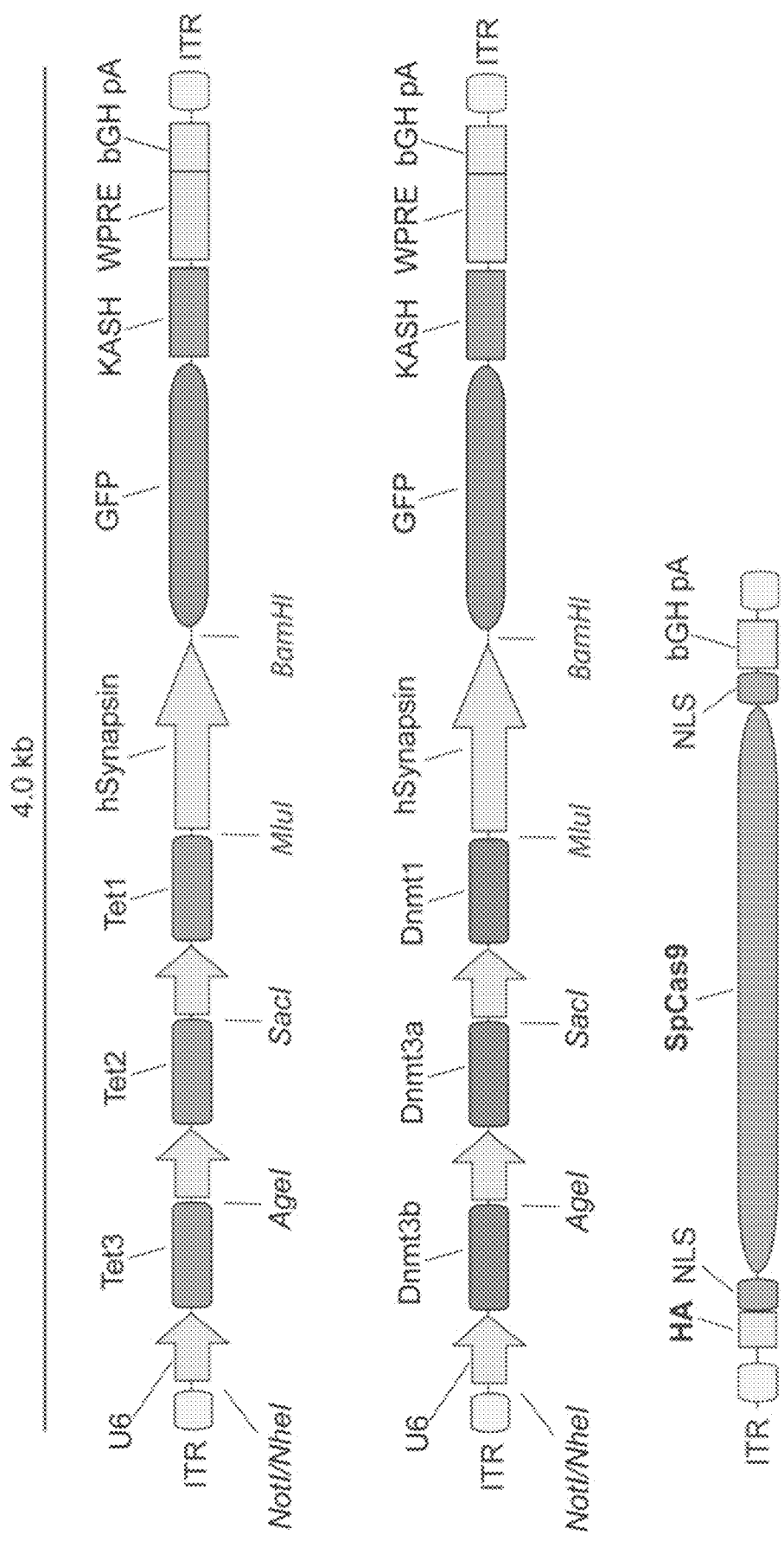
FIG. 34 shows a strategy of multiplex genome targeting using a 2-vector system in an AAV1/2 delivery system. Tet1-3 and Dnmt1, 3a and 3b gRNA under the control of the U6 promoter. GFP-KASH under the control of the human synapsin promoter. Restriction sides shows simple gRNA replacement strategy by subcloning. HA-tagged SpCas9 flanked by two nuclear localization signals (NLS) is shown. Both vectors are delivered into the brain by AAV1/2 virus in a 1:1 ratio.

Applicants designed and PCR amplified single gRNAs targeting mouse TET and DNMT family members (as described herein) Targeting efficiency was assessed in N2a cell line (FIG. 33). To obtain simultaneous modification of several genes in vivo, efficient gRNA was multiplexed in AAV-packaging vector (FIG. 34). To facilitate further analysis of system efficiency applicants added to the system expression cassette consistent of GFP-KASH domain fusion protein under control of human Synapsin I promoter (FIG. 34). This modification allows for further analysis of system efficiency in neuronal population (more detail procedure in section Sorting nuclei and in vivo results).

All 4 parts of the system were PCR amplified using Herculase II Fusion polymerase using following primers:

```
1st U6 Fw:
                                        (SEQ ID NO: 1553)
gagggtctcgtccttgcggccgcgctagcgagggcctatttcccatgatt
c 1st gRNA Rv:
                                        (SEQ ID NO: 1554)
ctcggtctcggtAAAAAAgcaccgactcggtgccacttttttcaagttgat aacggactagccttattttaacttgctaTTTCtagctctaaaacNNNNNN

NNNNNNNNNNNNNNNNGGTGTTTCGTCCTTTCCAC

2nd U6 Fw:
                                        (SEQ ID NO: 1555)
gagggtctcTTTaccggtgagggcctatttcccatgattcc 2nd gRNA Rv:
                                        (SEQ ID NO: 1556)
ctcggtctcctcAAAAAAgcaccgactcggtgccacttttttcaagttgat aacggactagccttattttaacttgctaTTTCtagctctaaaacNNNNNN

NNNNNNNNNNNNNNNNGGTGTTTCGTCCTTTCCAC
```

```
3rd U6 Fw:
                                      (SEQ ID NO: 1557)
gagggtctcTTTgagctcgagggcctatttcccatgattc 3rd gRNA Rv:
                                      (SEQ ID NO: 1558)
ctcggtctcgcgtAAAAAAgcaccgactcggtgccacttttcaagttga taacggactagccttattttaacttgctaTTTCtagctctaaaacNNNNN

NNNNNNNNNNNNNNNNNGGTGTTTCGTCCTTTCCA hSynGFP-kashFw:
                                      (SEQ ID NO: 1559)
gagggtctcTTacgcgtgtgtctagac hSynGFP-kashRv:
                                      (SEQ ID NO: 1560)
ctcggtctcAaggaCAGGGAAGGGAGCAGTGGTTCACGCCTGTAATCCCA

GCAATTTGGGAGGCCAAGGTGGGTAGATCACCTGAGATTAGGAGTTGC (NNNNNNNNNNNNNNNNNNNNN is a reverse compliment targeted genomic sequence)
```

Applicants used Golden Gate strategy to assemble all parts (1:1 molecular ratio) of the system in a single step reaction:

| | |
|---|---|
| 1$^{st}$ U6_gRNA | 18 ng |
| 2$^{nd}$ U6_gRNA | 18 ng |
| 3$^{rd}$ U6_gRNA | 18 ng |
| Syn_GFP-kash | 100 ng |
| 10x NEBuffer 4 | 1.0 μl |
| 10x BSA | 1.0 μl |
| 10 mM ATP | 1.0 μl |
| BsaI HF | 0.75 μl |
| T7 ligase | 0.25 μl |
| ddH$_2$O | 10 μl |

| Cycle number | Condition |
|---|---|
| 1-50 | 37° C. for 5 m, 21° C. for 5 m |

Golden Gate reaction product was PCR amplified using Herculase II fusion polymerase and following primers:

```
Fw
                                      (SEQ ID NO: 1561)
5'cctgtccttgcggccgcgctagcgagggcc Rv
                                      (SEQ ID NO: 1562)
5'cacgcggccgcaaggacagggaagggagcag
```

PCR product was cloned into AAV backbone, between ITR sequences using NotI restriction sites:

| PCR product digestion: | |
|---|---|
| Fast Digest buffer, 10X | 3 μl |
| FastDigest NotI | 1 μl |
| DNA | 1 μg |
| ddH$_2$O | up to 30 μl |

| AAV backbone digestion: | |
|---|---|
| Fast Digest buffer, 10X | 3 μl |
| FastDigest NotI | 1 μl |
| FastAP Alkaline Phosphatase | 1 μl |
| AAV backbone | 1 μl |
| ddH2O | up to 30 μl |

After 20 min incubation in 37° C. samples were purified using QIAQuick PCR purification kit. Standardized samples were ligated at a 1:3 vector:insert ratio as follows:

| | |
|---|---|
| Digested pUC19 | 50 ng |
| Digested insert | 1:3 vector:insert molar ratio |
| T7 ligase | 1 μl |
| 2X Rapid Ligation Buffer | 5 μl |
| ddH$_2$O | up to 10 μl |

After transformation of bacteria with ligation reaction product, applicants confirmed obtained clones with Sanger sequencing.

Figure 35:
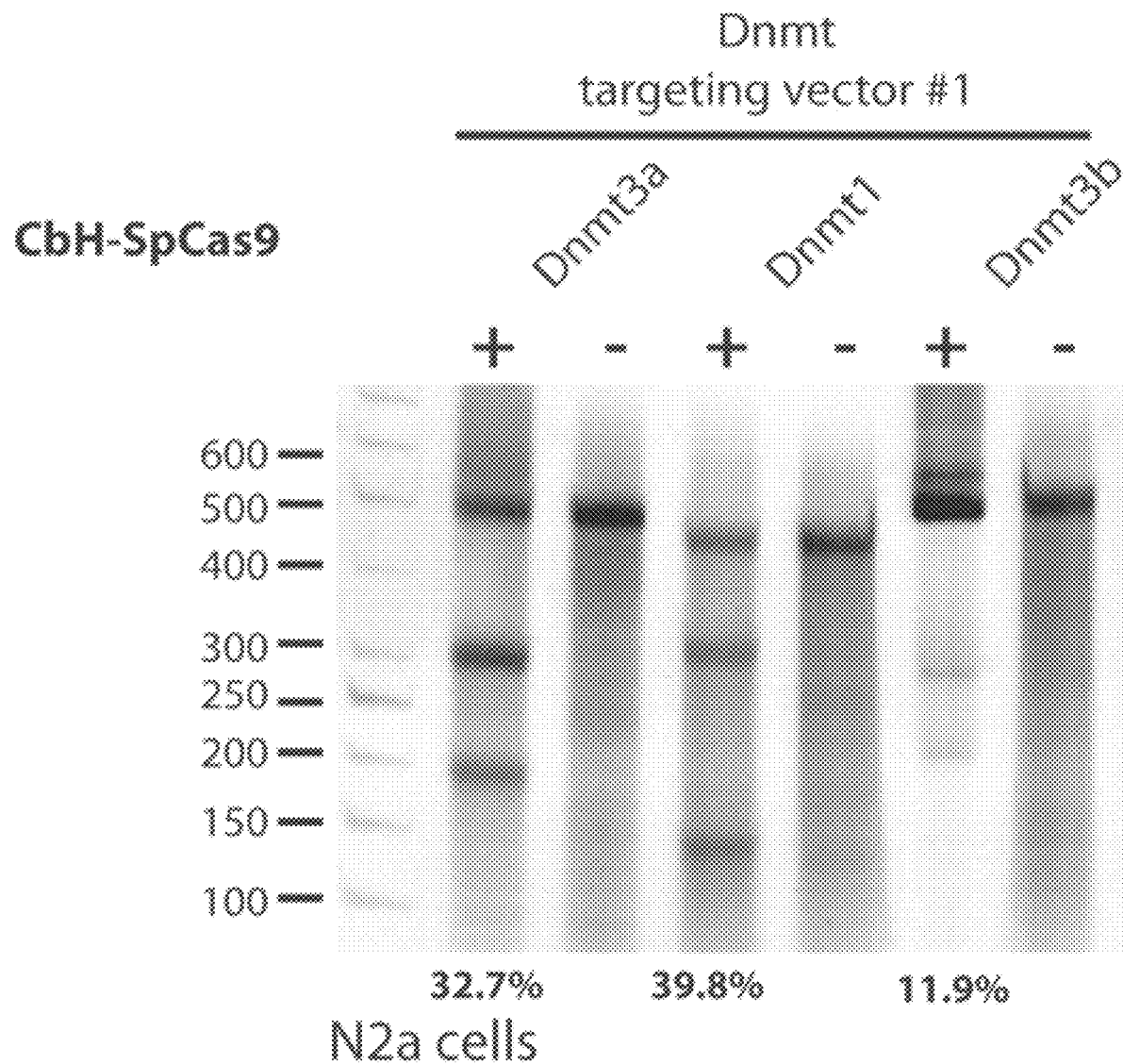
FIG. 35 shows verification of multiplex DNMT targeting vector #1 functionality using Surveyor assay. N2A cells were co-transfected with the DNMT targeting vector #1 (+) and the SpCas9 encoding vector for testing SpCas9 mediated cleavage of DNMTs genes family loci. gRNA only (−) is negative control. Cells were harvested for DNA purification and downstream processing 48 h after transfection.
Figure 36:
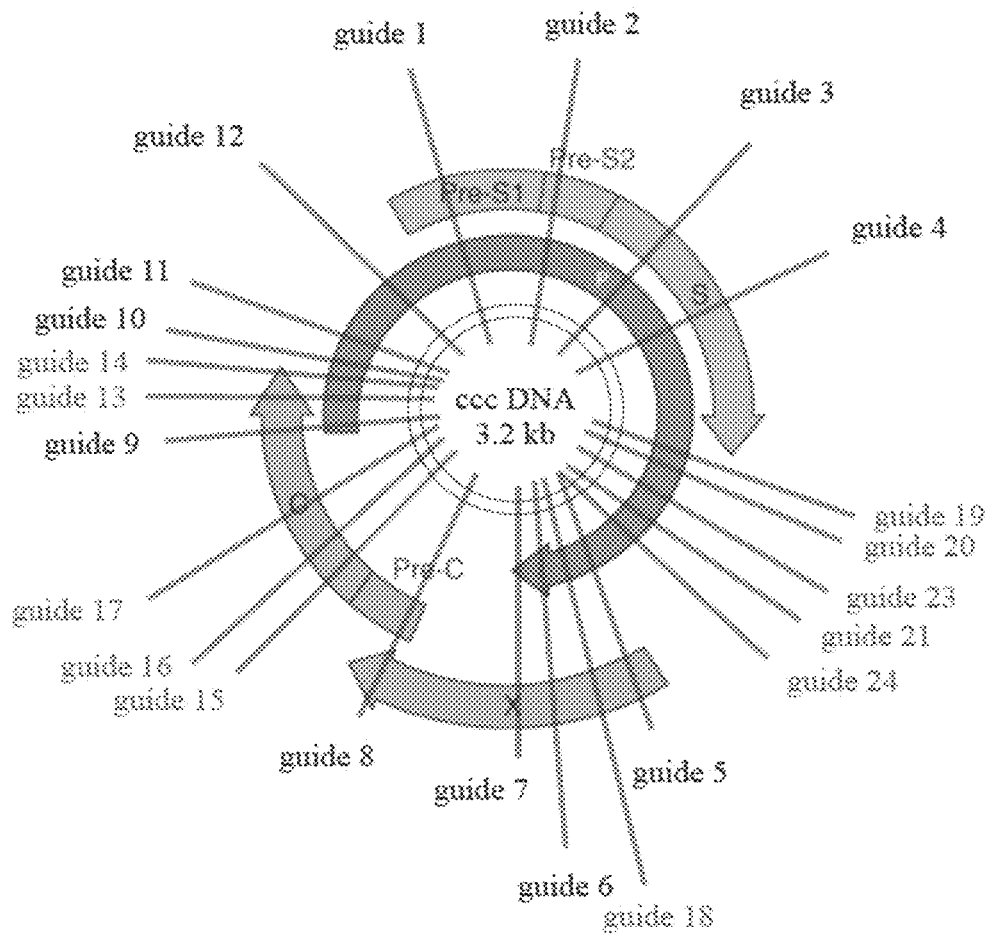
FIG. 36 shows guide RNA design for HBV targeting CRISPR constructs. Cleavage sites were optimized for low homology to human genomic DNA and conservation (guides 13-24)

Positive DNA clones were tested in N2a cells after co-transfection with Cas9 construct (FIGS. 35 and 36).

Design of New Cas9 Constructs for AAV Delivery

Figure 37:
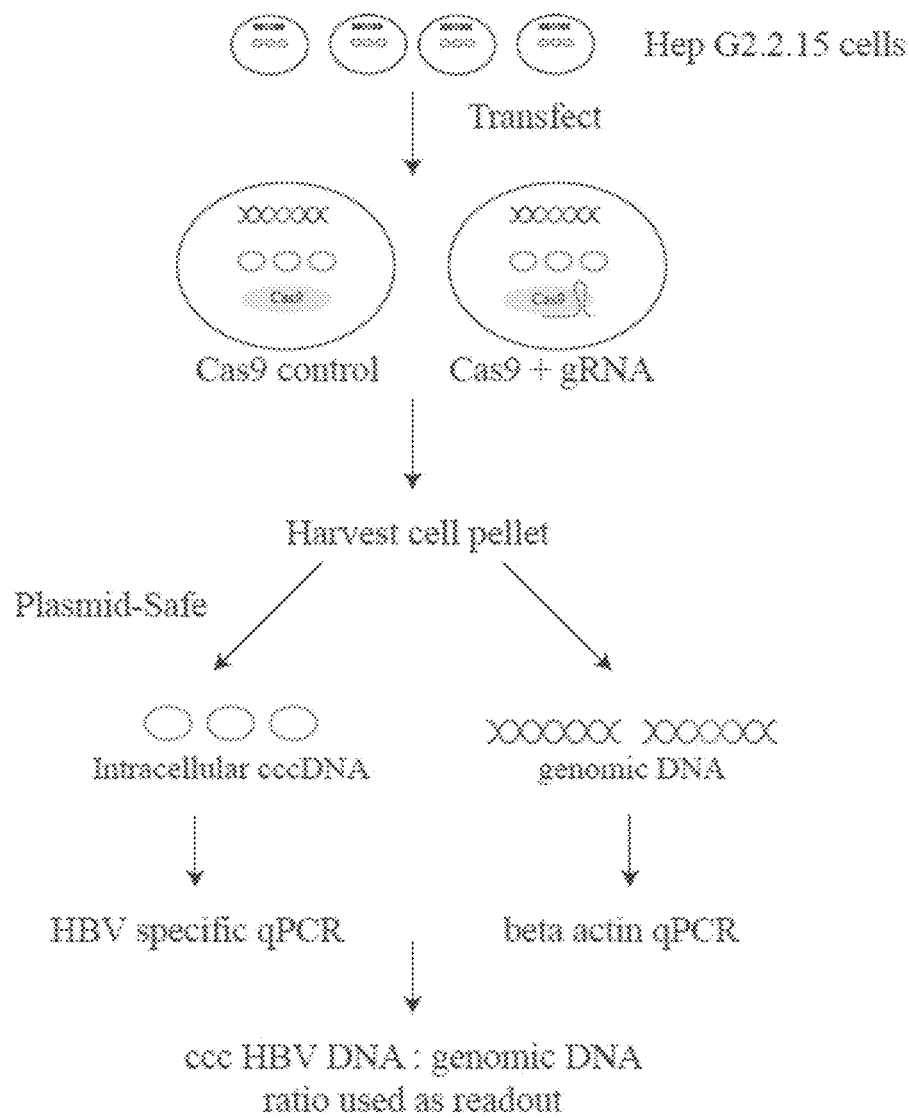
FIG. 37 shows a scheme for quantifying cccDNA in response to Cas9 treatment, 1st round of experiments.
Figure 38:
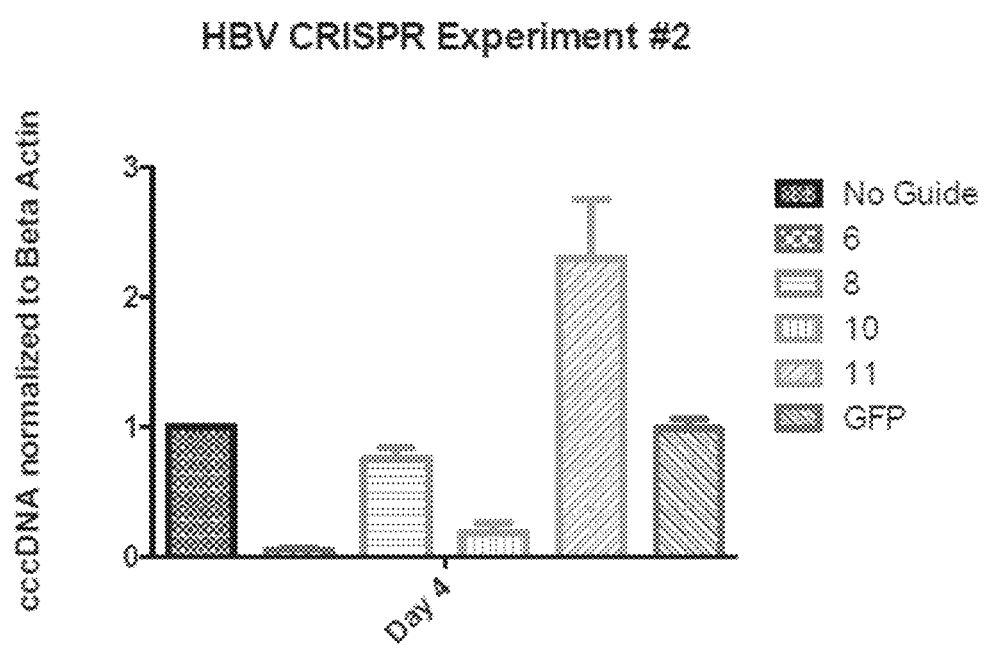
FIG. 38 shows qPCR results from 1st round of HepG2.2.15 experiments.
Figure 39:
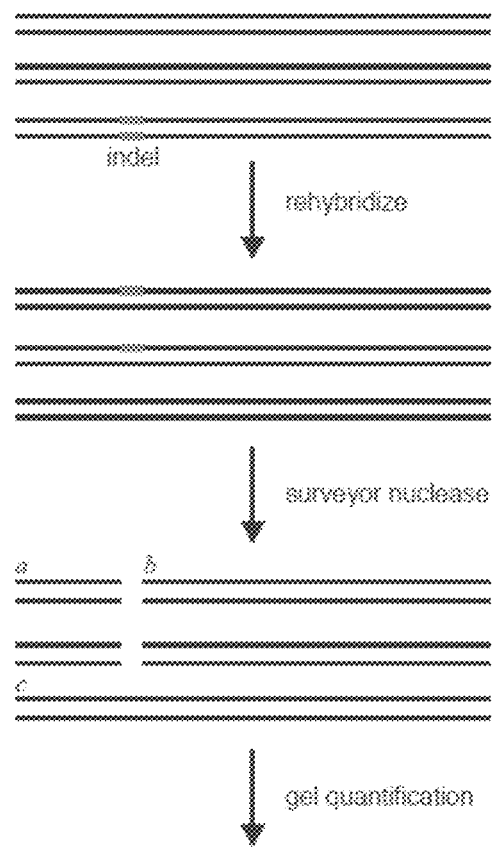
FIG. 39 shows a Surveyor assay for nuclease activity. Indels form as the result of imperfect NHEJ events due to repeated DSB formation from nuclease activity. For Cas9 targeted genomic loci indel formation at rates 10-30% are often observed and can approach 50%.

AAV delivery system despite its unique features has packing limitation—to successfully deliver expressing cassette in vivo it has to be in size <then 4.7 kb. To decrease the size of SpCas9 expressing cassette and facilitate delivery applicants tested several alteration: different promoters, shorter polyA signal and finally a smaller version of Cas9 from *Staphylococcus aureus* (SaCas9) (FIGS. 37 and 38). All tested promoters were previously tested and published to be active in neurons, including mouse Mecp2 (Gray et al., 2011), rat Map1b and truncated rat Map1b (Liu and Fischer, 1996). Alternative synthetic polyA sequence was previously shown to be functional as well (Levitt et al., 1989; Gray et al., 2011). All cloned constructs were expressed in N2a cells after transfection with Lipofectamine 2000, and tested with Western blotting method (FIG. 39).

Testing AAV Multiplex System in Primary Neurons

To confirm functionality of developed system in neurons, Applicants use primary neuronal cultures in vitro. Mouse cortical neurons was prepared according to the protocol published previously by Banker and Goslin (Banker and Goslin, 1988).

Neuronal cells are obtained from embryonic day 16. Embryos are extracted from the euthanized pregnant female and decapitated, and the heads are placed in ice-cold HBSS. The brains are then extracted from the skulls with forceps (#4 and #5) and transferred to another change of ice-cold HBSS. Further steps are performed with the aid of a stereoscopic microscope in a Petri dish filled with ice-cold HBSS and #5 forceps. The hemispheres are separated from each other and the brainstem and cleared of meninges. The hippocampi are then very carefully dissected and placed in a 15 ml conical tube filled with ice-cold HBSS. Cortices that remain after hippocampal dissection can be used for further cell isolation using an analogous protocol after removing the brain steam residuals and olfactory bulbs. Isolated hippocampi are washed three times with 10 ml ice-cold HBSS and dissociated by 15 min incubation with trypsin in HBSS (4 ml HBSS with the addition of 10 μl 2.5% trypsin per hippocampus) at 37° C. After trypsinization, the hippocampi are very carefully washed three times to remove any traces of trypsin with HBSS preheated to 37° C. and dissociated in warm HBSS. Applicants usually dissociate cells obtained from 10-12 embryos in 1 ml HBSS using 1 ml pipette tips and dilute dissociated cells up to 4 ml. Cells are plated at a density of 250 cells/mm2 and cultured at 37° C. and 5% CO2 for up to 3 week.

HBSS
435 ml H2O
50 ml 10× Hank's Balanced Salt Solution
16.5 ml 0.3M HEPES pH 7.3
5 ml penicillin-streptomycin solution
Filter (0.2 µm) and store 4° C.
Neuron Plating Medium (100 ml)
97 ml Neurobasal
2 ml B27 Supplement
1 ml penicillin-streptomycin solution
250 µl glutamine
125 µl glutamate Neurons are transduced with concentrated AAV1/2 virus or AAV1 virus from filtered medium of HEK293FT cells, between 4-7 days in culture and keep for at least one week in culture after transduction to allow for delivered gene expression.

AAV-Driven Expression of the System

Figure 42:
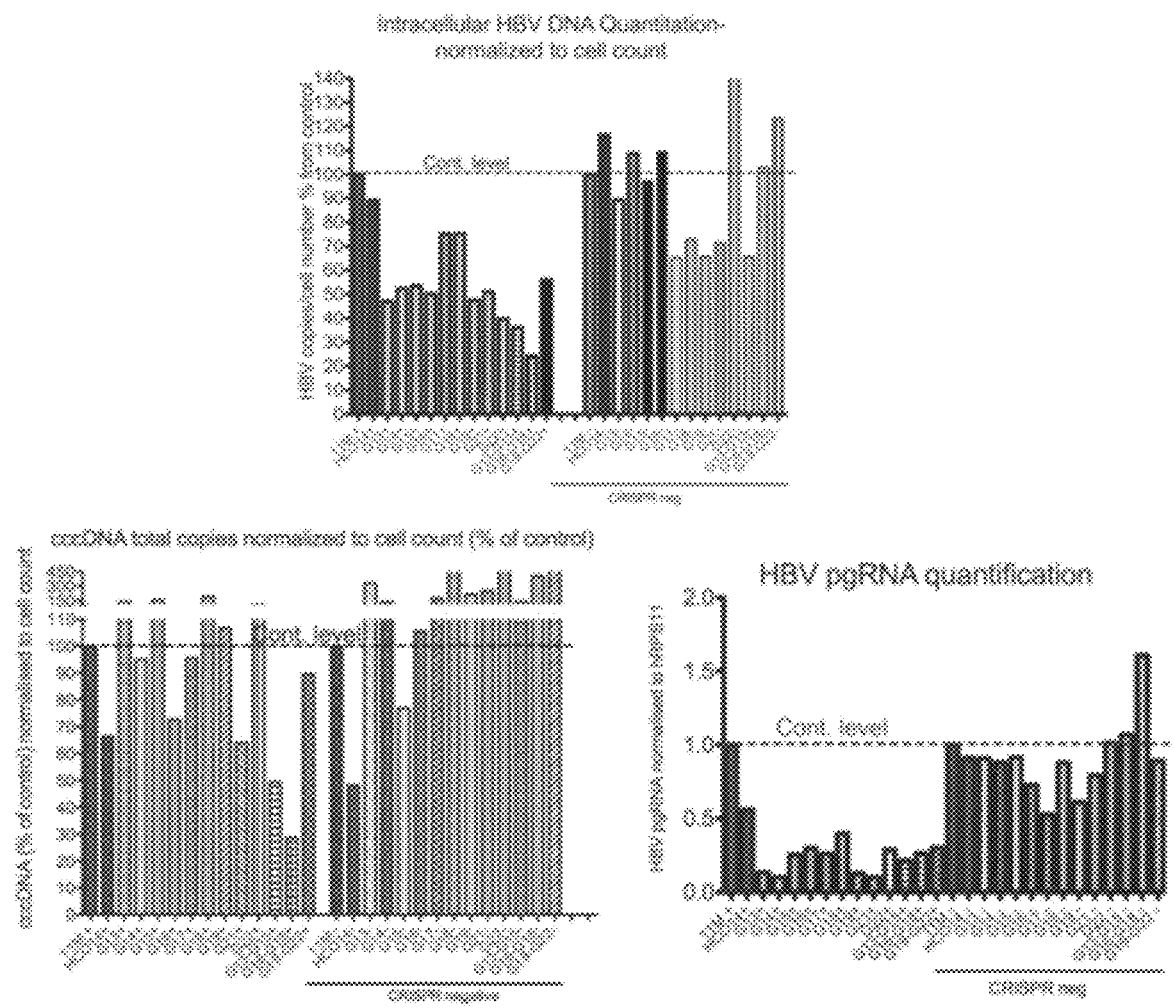
FIG. 42 shows HepG2.2.15 results using sorting based normalization.

Applicants confirmed expression of SpCas9 and SaCas9 in neuronal cultures after AAV delivery using Western blot method (FIG. 42). One week after transduction neurons were collected in NuPage SDS loading buffer with β-mercaptoethanol to denaturate proteins in 95° C. for 5 min. Samples were separated on SDS PAGE gel and transferred on PVDF membrane for WB protein detection. Cas9 proteins were detected with HA antibody.

Figure 50:
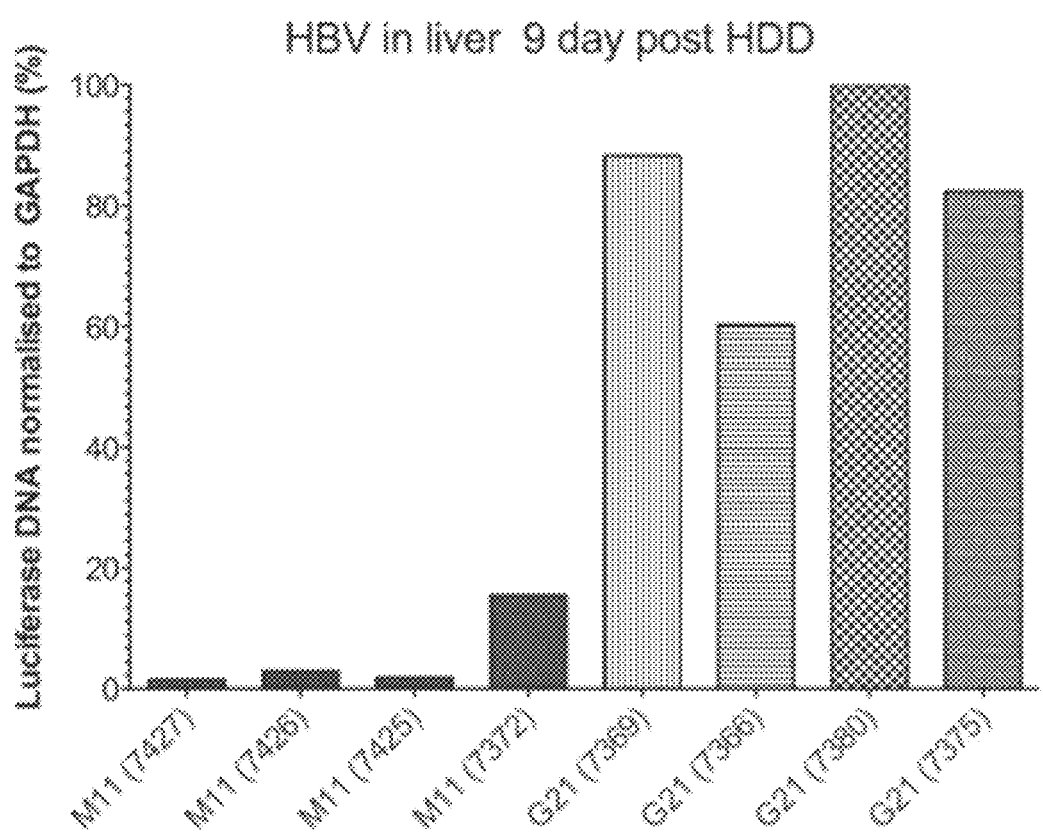
FIG. 50 shows Cohort 2-liver analysis 9d post HDD.

Expression of Syn-GFP-kash from gRNA multiplex AAV was confirmed with fluorescent microscopy (FIG. 50).

Toxicity

Figure 44:
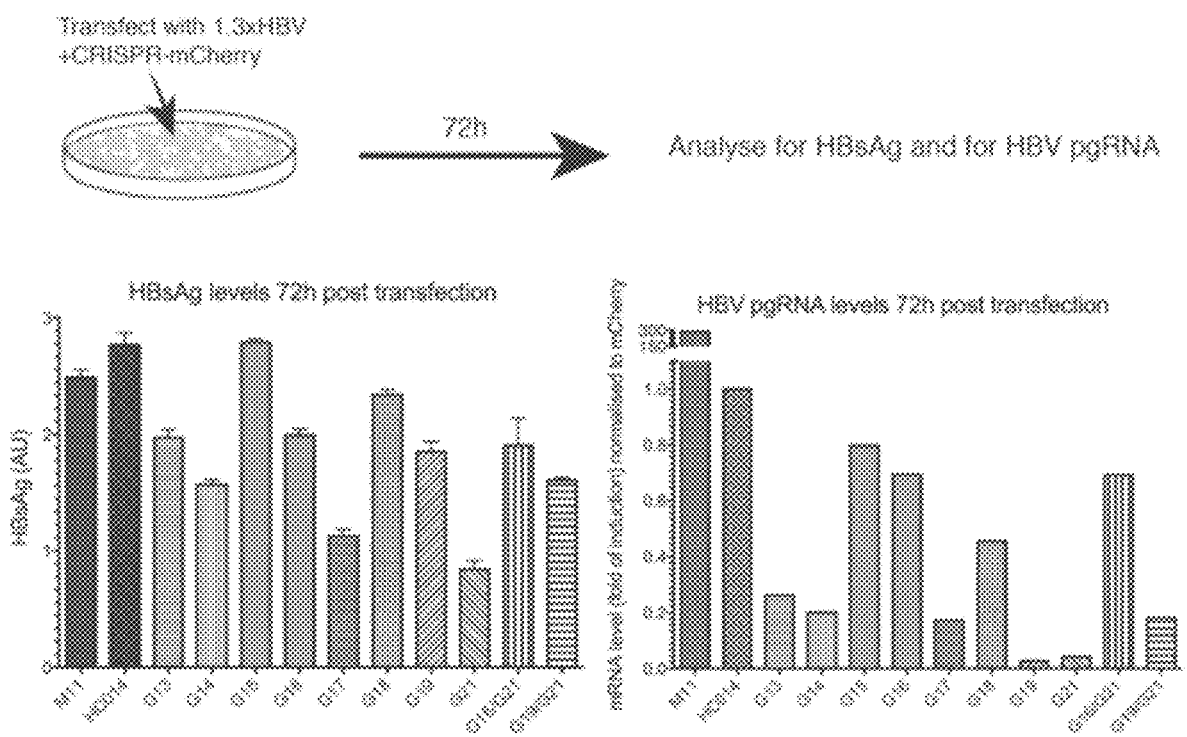
FIG. 44 shows HepG2 co-transfection experiments.
Figure 45:
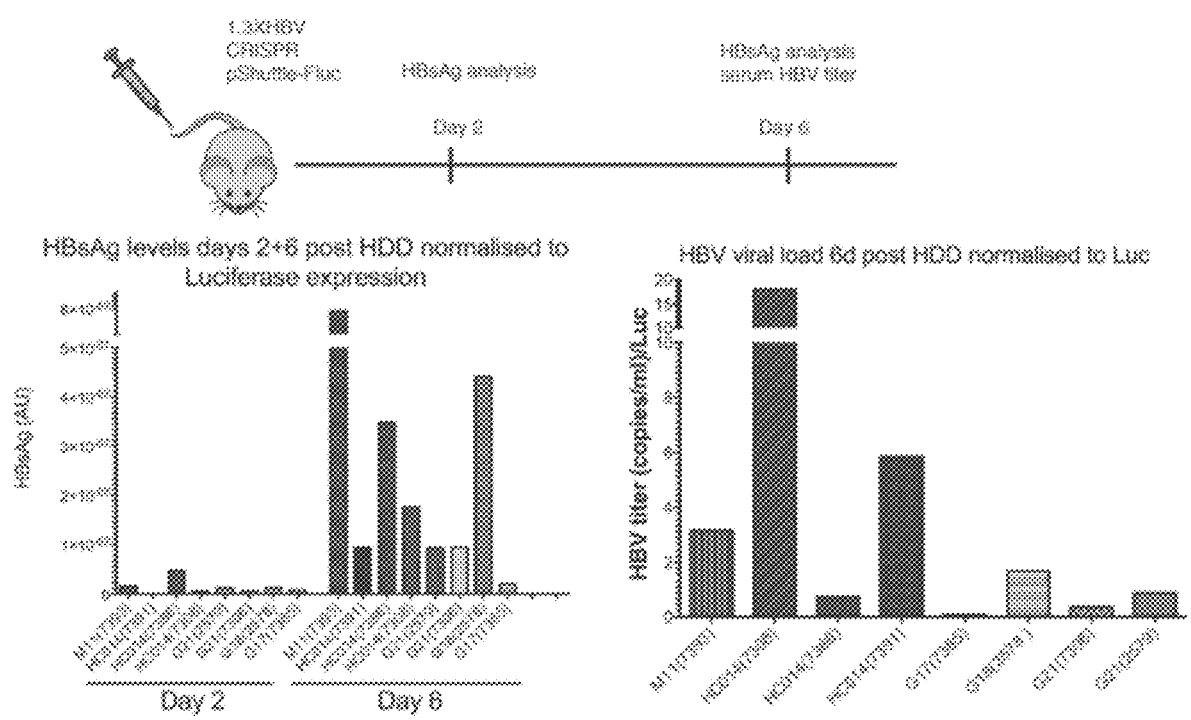
FIG. 45 shows HDD data for Cohort 1.

To assess the toxicity of AAV with CRISPR system Applicants tested overall morphology of neurons one week after virus transduction (FIG. 45). Additionally, Applicants tested potential toxicity of designed system with the LIVE/DEAD® Cell Imaging Kit, which allows to distinguish live and dead cells in culture. It is based on the presence of intracellular esterase activity (as determined by the enzymatic conversion of the non-fluorescent calcein AM to the intensely green fluorescent calcein). On the other hand, the red, cell-impermeant component of the Kit enters cells with damaged membranes only and bind to DNA generating fluorescence in dead cells. Both flourophores can be easily visualized in living cells with fluorescent microscopy. AAV-driven expression of Cas9 proteins and multiplex gRNA constructs in the primary cortical neurons was well tolerated and not toxic (FIGS. 43 and 44), what indicates that designed AAV system is suitable for in vivo tests.

Virus Production

Concentrated virus was produced according to the methods described in McClure et al., 2011. Supernatant virus production occurred in HEK293FT cells.

Brain Surgeries

For viral vector injections 10-15 week old male C57BL/6N mice were anesthetized with a Ketamine/Xylazine cocktail (Ketamine dose of 100 mg/kg and Xylazine dose of 10 mg/kg) by intraperitoneal injection. Intraperitonial administration of Buprenex was used as a pre-emptive analgesic (1 mg/kg). Animals were immobilized in a Kopf stereotaxic apparatus using intra-aural positioning studs and tooth bar to maintain an immobile skull. Using a hand-held drill, a hole (1-2 mm) at −3.0 mm posterior to Bregma and 3.5 mm lateral for injection in the CA1 region of the hippocampus was made. Using 30G World Precision Instrument syringe at a depth of 2.5 mm, the solution of AAV viral particles in a total volume of 1 ul was injected. The injection was monitored by a 'World Precision Instruments UltraMicroPump3' injection pump at a flow rate of 0.5 ul/min to prevent tissue damage. When the injection was complete, the injection needle was removed slowly, at a rate of 0.5 mm/min. After injection, the skin was sealed with 6-0 Ethilon sutures. Animals were postoperatively hydrated with 1 mL lactated Ringer's (subcutaneous) and housed in a temperature controlled (37° C.) environment until achieving an ambulatory recovery. 3 weeks after surgery animals were euthanized by deep anesthesia followed by tissue removal for nuclei sorting or with 4% paraformaldehyde perfusion for immunochemistry.

Sorting Nuclei and In Vivo Results

Applicants designed a method to specifically genetically tag the gRNA targeted neuronal cell nuclei with GFP for Fluorescent Activated Cell Sorting (FACS) of the labeled cell nuclei and downstream processing of DNA, RNA and nuclear proteins. To that purpose the applicants' multiplex targeting vector was designed to express both a fusion protein between GFP and the mouse nuclear membrane protein domain KASH (Starr D A, 2011, Current biology) and the 3 gRNAs to target specific gene loci of interest (FIG. 34). GFP-KASH was expressed under the control of the human Synapsin promoter to specifically label neurons. The amino acid of the fusion protein GFP-KASH was:

(SEQ ID NO: 1563)
MVSKGEELFTGVVPILVELDGDVNGHKFSVSGEGEGDATYGKLTLKFICT

TGKLPVPWPTLVTTLTYGVQCFSRYPDHMKQHDFFKSAMPEGYVQERTIF

FKDDGNYKTRAEVKFEGDTLVNRIELKGIDFKEDGNILGHKLEYNYNSHN

VYIMADKQKNGIKVNFKIRHNIEDGSVQLADHYQQNTPIGDGPVLLPDNH

YLSTQSALSKDPNEKRDHMVLLEFVTAAGITLGMDELYKSGLRSREEEEE

TDSRMPHLDSPGSSQPRRSFLSRVIRAALPLQLLLLLLLLLACLLPASED

DYSCTQANNFARSFYPMLRYTNGPPPT

One week after AAV1/2 mediated delivery into the brain a robust expression of GFP-KASH was observed. For FACS and downstream processing of labeled nuclei, the hippocampi were dissected 3 weeks after surgery and processed for cell nuclei purification using a gradient centrifugation step. For that purpose the tissue was homogenized in 320 mM Sucrose, 5 mM CaCl, 3 mM Mg(Ac)2, 10 mM Tris pH 7.8, 0.1 mM EDTA, 0.1% NP40, 0.1 mM Phenylmethanesulfonyl fluoride (PMSF), 1 mM β-mercaptoethanol using 2 ml Dounce homogenizer (Sigma) The homogenisate was centrifuged on a 25% to 29% Optiprep® gradient according to the manufacture's protocol for 30 min at 3.500 rpm at 4° C. The nuclear pellet was resuspended in 340 mM Sucrose, 2 mM MgCl2, 25 mM KCl, 65 mM glycerophosphate, 5% glycerol, 0.1 mM PMSF, 1 mM β-mercaptoethanol and Vybrant® DyeCycle™ Ruby Stain (Life technologies) was added to label cell nuclei (offers near-infrared emission for DNA). The labeled and purified nuclei were sorted by FACS using an Aria Flu-act-cell sorter and BDFACS Diva software. The sorted GFP+ and GFP− nuclei were finally used to purify genomic DNA using DNAeasy Blood & Tissue Kit (Qiagen) for Surveyor assay analysis of the targeted genomic regions. The same approach can be easily used to purify nuclear RNA or protein from targeted cells for downstream processing. Due to the 2-vector system (FIG. 34) the applicants using in this approach efficient Cas9 mediated DNA cleavage was expected to occur only in a small subset of cells in the brain (cells which were co-infected with both the multiplex targeting vector and the Cas9 encoding vector). The method described here enables the applicants to specifically purify DNA, RNA and nuclear proteins from the cell population expressing the 3 gRNAs of interest and therefore are supposed to undergo Cas9 mediated DNA cleavage. By using this method the applicants were able to visualize efficient DNA cleavage in vivo occurring only in a small subset of cells.

Essentially, what Applicants have shown here is targeted in vivo cleavage. Furthermore, Applicants used a multiple approach, with several different sequences targeted at the same time, but independently. Presented system can be applied for studying brain pathologic conditions (gene knock out, e.g. Parkinson disease) and also open a field for further development of genome editing tools in the brain. By replacing nuclease activity with gene transcription regulators or epigenetic regulators it will be possible to answer whole spectrum of scientific question about role of gene regulation and epigenetic changes in the brain in not only in the pathologic conditions but also in physiological process as learning and memory formation. Finally, presented technology can be applied in more complex mammalian system as primates, what allows to overcome current technology limitations.

Example 26: AAV Production System or Protocol

An AAV production system or protocol that was developed for, and works particularly well with, high through put screening uses is provided herein, but it has broader applicability in the present invention as well. Manipulating endogenous gene expression presents various challenges, as the rate of expression depends on many factors, including regulatory elements, mRNA processing, and transcript stability. To overcome this challenge, Applicants developed an adeno-associated virus (AAV)-based vector for the delivery. AAV has an ssDNA-based genome and is therefore less susceptible to recombination.

AAV1/2 (serotype AAV1/2, i.e., hybrid or mosaic AAV1/AAV2 capsid AAV) heparin purified concentrated virus protocol
Media: D10+HEPES
500 ml bottle DMEM high glucose+Glutamax (GIBCO)
50 ml Hyclone FBS (heat-inactivated) (Thermo Fischer)
5.5 ml HEPES solution (1M, GIBCO)
Cells: low passage HEK293FT (passage <10 at time of virus production, thaw new cells of passage 2-4 for virus production, grow up for 3-5 passages)
Transfection reagent: Polyethylenimine (PEI) "Max"
Dissolve 50 mg PEI "Max" in 50 ml sterile Ultrapure H2O
Adjust pH to 7.1
Filter with 0.22 um fliptop filter
Seal tube and wrap with parafilm
Freeze aliquots at −20° C. (for storage, can also be used immediately)
Cell Culture
Culture low passage HEK293FT in D10+HEPES
Passage everyday between 1:2 and 1:2.5
Advantageously do not allow cells to reach more than 85% confluency
For T75
Warm 10 ml HBSS (—Mg2+, —Ca2+, GIBCO)+1 ml TrypLE Express (GIBCO) per flask to 37° C. (Waterbath)
Aspirate media fully
Add 10 ml warm HBSS gently (to wash out media completely)
Add 1 ml TrypLE per Flask
Place flask in incubator (37° C.) for 1 min
Rock flask to detach cells
Add 9 ml D10+HEPES media (37° C.)
Pipette up and down 5 times to generate single cell suspension
Split at 1:2-1:2.5 (12 ml media for T75) ratio (if cells are growing more slowly, discard and thaw a new batch, they are not in optimal growth)
transfer to T225 as soon as enough cells are present (for ease of handling large amounts of cells)
AAV Production (5*15 cm Dish Scale Per Construct):
Plate 10 million cells in 21.5 ml media into a 15 cm dish
Incubate for 18-22 hours at 37° C.
Transfection is ideal at 80% confluence
Per Plate
Prewarm 22 ml media (D10+HEPES)
Prepare Tube with DNA Mixture (Use Endofree Maxiprep DNA):
5.2 ug vector of interest plasmid
4.35 ug AAV 1 serotype plasmid
4.35 ug AAV 2 serotype plasmid
10.4 ug pDF6 plasmid (adenovirus helper genes) Vortex to mix
Add 434 uL DMEM (no serum!)
Add 130 ul PEI solution
Vortex 5-10 seconds
Add DNA/DMEM/PEI mixture to prewarmed media
Vortex briefly to mix
Replace media in 15 cm dish with DNA/DMEM/PEI mixture
Return to 37° C. incubator
Incubate 48 h before harvesting (make sure medium isn't turning too acidic)
Virus Harvest:
1. aspirate media carefully from 15 cm dish dishes (advantageously do not dislodge cells)
2. Add 25 ml RT DPBS (Invitrogen) to each plate and gently remove cells with a cell scraper. Collect suspension in 50 ml tubes.
3. Pellet cells at 800× g for 10 minutes.
4. Discard supernatant
Pause Point: Freeze Cell Pellet at −80C if Desired
5. resuspend pellet in 150 mM NaCl, 20 mM Tris pH 8.0, use 10 ml per tissue culture plate.
6. Prepare a fresh solution of 10% sodium deoxycholate in dH2O. Add 1.25 ml of this per tissue culture plate for a final concentration of 0.5%. Add benzonase nuclease to a final concentration of 50 units per ml. Mix tube thoroughly.
7. Incubate at 37° C. for 1 hour (Waterbath).
8. Remove cellular debris by centrifuging at 3000× g for 15 mins. Transfer to fresh 50 ml tube and ensure all cell debris has been removed to prevent blocking of heparin columns.
Heparin Column Purification of AAV1/2:
1. Set up HiTrap heparin columns using a peristaltic pump so that solutions flow through the column at 1 ml per minute. It is important to ensure no air bubbles are introduced into the heparin column.
2. Equilibrate the column with 10 ml 150 mM NaCl, 20 mM Tris, pH 8.0 using the peristaltic pump.
3. Binding of virus: Apply 50 ml virus solution to column and allow to flow through.

4. Wash step 1: column with 20 ml 100 mM NaCl, 20 mM Tris, pH 8.0. (using the peristaltic pump)
5. Wash step 2: Using a 3 ml or 5 ml syringe continue to wash the column with 1 ml 200 mM NaCl, 20 mM Tris, pH 8.0, followed by 1 ml 300 mM NaCl, 20 mM Tris, pH 8.0.

Discard the flow-through.
(prepare the syringes with different buffers during the 50 min flow through of virus solution above)
6. Elution Using 5 ml syringes and gentle pressure (flow rate of <1 ml/min) elute the virus from the column by applying:
1.5 ml 400 mM NaCl, 20 mM Tris, pH 8.0
3.0 ml 450 mM NaCl, 20 mM Tris, pH 8.0
1.5 ml 500 mM NaCl, 20 mM Tris, pH 8.0

Collect these in a 15 ml centrifuge tube.

Concentration of AAV1/2:
1. Concentration step 1: Concentrate the eluted virus using Amicon ultra 15 ml centrifugal filter units with a 100,000 molecular weight cutoff. Load column eluate into the concentrator and centrifuge at 2000× g for 2 minutes (at room temperature. Check concentrated volume—it should be approximately 500 µl. If necessary, centrifuge in 1 min intervals until correct volume is reached.
2. buffer exchange: Add 1 ml sterile DPBS to filter unit, centrifuge in 1 min intervals until correct volume (500 ul) is reached.
3. Concentration step 2: Add 500 ul concentrate to an Amicon Ultra 0.5 ml 100K filter unit. Centrifuge at 6000 g for 2 min. Check concentrated volume—it should be approximately 100 µl. If necessary, centrifuge in 1 min intervals until correct volume is reached.
4. Recovery: Invert filter insert and insert into fresh collection tube. Centrifuge at 1000 g for 2 min.

Aliquot and freeze at −80° C.
1 ul is typically required per injection site, small aliquots (e.g. 5 ul) are therefore recommended (avoid freeze-thaw of virus).
determine DNaseI-resistant GC particle titer using qPCR (see separate protocol)

Materials
Amicon Ultra, 0.5 ml, 100K; MILLIPORE; UFC510024
Amicon Ultra, 15 ml, 100K; MILLIPORE; UFC910024
Benzonase nuclease; Sigma-Aldrich, E1014
HiTrap Heparin cartridge; Sigma-Aldrich; 54836
Sodium deoxycholate; Sigma-Aldrich; D5670

AAV1 Supernatant Production Protocol
Media: D10+HEPES
500 ml bottle DMEM high glucose+Glutamax (Invitrogen)
50 ml Hyclone FBS (heat-inactivated) (Thermo Fischer)
5.5 ml HEPES solution (1M, GIBCO)
Cells: low passage HEK293FT (passage <10 at time of virus production)
Thaw new cells of passage 2-4 for virus production, grow up for 2-5 passages
Transfection reagent: Polyethylenimine (PEI) "Max"
Dissolve 50 mg PEI "Max" in 50 ml sterile Ultrapure H2O
Adjust pH to 7.1
Filter with 0.22 um fliptop filter
Seal tube and wrap with parafilm
Freeze aliquots at −20° C. (for storage, can also be used immediately)

Cell Culture
Culture low passage HEK293FT in D10+HEPES Passage everyday between 1:2 and 1:2.5
Advantageously do let cells reach more than 85% confluency
For T75
Warm 10 ml HBSS (—Mg2+, —Ca2+, GIBCO)+1 ml TrypLE Express (GIBCO) per flask to 37° C. (Waterbath)
Aspirate media fully
Add 10 ml warm HBSS gently (to wash out media completely)
Add 1 ml TrypLE per Flask
Place flask in incubator (37° C.) for 1 min
Rock flask to detach cells
Add 9 ml D10+HEPES media (37° C.)
Pipette up and down 5 times to generate single cell suspension
Split at 1:2-1:2.5 (12 ml media for T75) ratio (if cells are growing more slowly, discard and thaw a new batch, they are not in optimal growth)
transfer to T225 as soon as enough cells are present (for ease of handling large amounts of cells)

AAV production (single 15 cm dish scale)
Plate 10 million cells in 21.5 ml media into a 15 cm dish
Incubate for 18-22 hours at 37° C.
Transfection is ideal at 80% confluence per plate
Prewarm 22 ml media (D10+HEPES)
Prepare tube with DNA mixture (use endofree maxiprep DNA):
5.2 ug vector of interest plasmid
8.7 ug AAV 1 serotype plasmid
10.4 ug DF6 plasmid (adenovirus helper genes)
Vortex to mix
Add 434 uL DMEM (no serum!) Add 130 ul PEI solution
Vortex 5-10 seconds
Add DNA/DMEM/PEI mixture to prewarmed media
Vortex briefly to mix
Replace media in 15 cm dish with DNA/DMEM/PEI mixture
Return to 37° C. incubator
Incubate 48 h before harvesting (advantageously monitor to ensure medium is not turning too acidic)

Virus Harvest:
Remove supernatant from 15 cm dish
Filter with 0.45 um filter (low protein binding) Aliquot and freeze at −80° C.

Transduction (primary neuron cultures in 24-well format, 5 DIV)
Replace complete neurobasal media in each well of neurons to be transduced with fresh neurobasal (usually 400 ul out of 500 ul per well is replaced)
Thaw AAV supernatant in 37° C. waterbath
Let equilibrate in incubator for 30 min
Add 250 ul AAV supernatant to each well
Incubate 24 h at 37° C.
Remove media/supernatant and replace with fresh complete neurobasal
Expression starts to be visible after 48 h, saturates around 6-7 Days Post Infection
Constructs for pAAV plasmid with GOI should not exceed 4.8 kb including both ITRS.

Example of a human codon optimized sequence (i.e. being optimized for expression in humans) sequence: SaCas9 is provided below:

(SEQ ID NO: 1564)
ACCGGTGCCACCATGTACCCATACGATGTTCCAGATTACGCTTCGCCGAA

GAAAAAGCGCAAGGTCGAAGCGTCCATGAAAAGGAACTACATTCTGGGGC

TGGACATCGGGATTACAAGCGTGGGGTATGGGATTATTGACTATGAAACA

AGGGACGTGATCGACGCAGGCGTCAGACTGTTCAAGGAGGCCAACGTGGA

AAACAATGAGGGACGGAGAAGCAAGAGGGGAGCCAGGCGCCTGAAACGAC

GGAGAAGGCACAGAATCCAGAGGGTGAAGAAACTGCTGTTCGATTACAAC

CTGCTGACCGACCATTCTGAGCTGAGTGGAATTAATCCTTATGAAGCCAG

GGTGAAAGGCCTGAGTCAGAAGCTGTCAGAGGAAGAGTTTTCCGCAGCTC

TGCTGCACCTGGCTAAGCGCCGAGGAGTGCATAACGTCAATGAGGTGGAA

GAGGACACCGGCAACGAGCTGTCTACAAAGGAACAGATCTCACGCAATAG

CAAAGCTCTGGAAGAGAAGTATGTCGCAGAGCTGCAGCTGGAACGGCTGA

AGAAAGATGGCGAGGTGAGAGGGTCAATTAATAGGTTCAAGACAAGCGAC

TACGTCAAAGAAGCCAAGCAGCTGCTGAAAGTGCAGAAGGCTTACCACCA

GCTGGATCAGAGCTTCATCGATACTTATATCGACCTGCTGGAGACTCGGA

GAACCTACTATGAGGGACCAGGAGAAGGGAGCCCCTTCGGATGGAAAGAC

ATCAAGGAATGGTACGAGATGCTGATGGGACATTGCACCTATTTCCAGA

AGAGCTGAGAAGCGTCAAGTACGCTTATAACGCAGATCTGTACAACGCCC

TGAATGACCTGAACAACCTGGTCATCACCAGGGATGAAAACGAGAAACTG

GAATACTATGAGAAGTTCCAGATCATCGAAAACGTGTTTAAGCAGAAGAA

AAAGCCTACACTGAAACAGATTGCTAAGGAGATCCTGGTCAACGAAGAGG

ACATCAAGGGCTACCGGGTGACAAGCACTGGAAAACCAGAGTTCACCAAT

CTGAAAGTGTATCACGATATTAAGGACATCACAGCACGGAAAGAAATCAT

TGAGAACGCCGAACTGCTGGATCAGATTGCTAAGATCCTGACTATCTACC

AGAGCTCCGAGGACATCCAGGAAGAGCTGACTAACCTGAACAGCGAGCTG

ACCCAGGAAGAGATCGAACAGATTAGTAATCTGAAGGGGTACACCGGAAC

ACACAACCTGTCCCTGAAAGCTATCAATCTGATTCTGGATGAGCTGTGGC

ATACAAACGACAATCAGATTGCAATCTTTAACCGGCTGAAGCTGGTCCCA

AAAAAGGTGGACCTGAGTCAGCAGAAAGAGATCCCAACCACACTGGTGGA

CGATTTCATTCTGTCACCCGTGGTCAAGCGGAGCTTCATCCAGAGCATCA

AAGTGATCAACGCCATCATCAAGAAGTACGGCCTGCCCAATGATATCATT

ATCGAGCTGGCTAGGGAGAAGAACAGCAAGGACGCACAGAAGATGATCAA

TGAGATGCAGAAACGAAACCGGCAGACCAATGAACGCATTGAAGAGATTA

TCCGAACTACCGGGAAAGAAACGCAAAGTACCTGATTGAAAAAATCAAG

CTGCACGATATGCAGGAGGGAAAGTGTCTGTATTCTCTGGAGGCCATCCC

CCTGGAGGACCTGCTGAACAATCCATTCAACTACGAGGTCGATCATATTA

TCCCCAGAAGCGTGTCCTTCGACAATTCCTTTAACAACAAGGTGCTGGTC

AAGCAGGAAGAGAACTCTAAAAAGGGCAATAGGACTCCTTTCCAGTACCT

GTCTAGTTCAGATTCCAAGATCTCTTACGAAACCTTTAAAAAGCACATTC

-continued

TGAATCTGGCCAAAGGAAAGGGCCGCATCAGCAAGACCAAAAAGGAGTAC

CTGCTGGAAGAGCGGGACATCAACAGATTCTCCGTCCAGAAGGATTTTAT

TAACCGGAATCTGGTGGACACAAGATACGCTACTCGCGGCCTGATGAATC

TGCTGCGATCCTATTTCCGGGTGAACAATCTGGATGTGAAAGTCAAGTCC

ATCAACGGCGGGTTCACATCTTTTCTGAGGCGCAAATGGAAGTTTAAAAA

GGAGCGCAACAAAGGGTACAAGCACCATGCCGAAGATGCTCTGATTATCG

CAAATGCCGACTTCATCTTTAAGGAGTGGAAAAAGCTGGACAAAGCCAAG

AAAGTGATGGAGAACCAGATGTTCGAAGAGAAGCAGGCCGAATCTATGCC

CGAAATCGAGACAGAACAGGAGTACAAGGAGATTTTCATCACTCCTCACC

AGATCAAGCATATCAAGGATTTCAAGGACTACAAGTACTCTCACCGGGTG

GATAAAAAGCCCAACAGAGAGCTGATCAATGACACCCTGTATAGTACAAG

AAAAGACGATAAGGGGAATACCCTGATTGTGAACAATCTGAACGGACTGT

ACGACAAAGATAATGACAAGCTGAAAAAGCTGATCAACAAAAGTCCCGAG

AAGCTGCTGATGTACCACCATGATCCTCAGACATATCAGAAACTGAAGCT

GATTATGGAGCAGTACGGCGACGAGAAGAACCCACTGTATAAGTACTATG

AAGAGACTGGGAACTACCTGACCAAGTATAGCAAAAAGGATAATGGCCCC

GTGATCAAGAAGATCAAGTACTATGGGAACAAGCTGAATGCCCATCTGGA

CATCACAGACGATTACCCTAACAGTCGCAACAAGGTGGTCAAGCTGTCAC

TGAAGCCATACAGATTCGATGTCTATCTGGACAACGGCGTGTATAAATTT

GTGACTGTCAAGAATCTGGATGTCATCAAAAAGGAGAACTACTATGAAGT

GAATAGCAAGTGCTACGAAGAGGCTAAAAAGCTGAAAAAGATTAGCAACC

AGGCAGAGTTCATCGCCTCCTTTTACAACAACGACCTGATTAAGATCAAT

GGCGAACTGTATAGGGTCATCGGGGTGAACAATGATCTGCTGAACCGCAT

TGAAGTGAATATGATTGACATCACTTACCGAGAGTATCTGGAAAACATGA

ATGATAAGCGCCCCCCTCGAATTATCAAAACAATTGCCTCTAAGACTCAG

AGTATCAAAAAGTACTCAACCGACATTCTGGGAAACCTGTATGAGGTGAA

GAGCAAAAAGCACCCTCAGATTATCAAAAAGGGCTAAGAATTC

Example 27: Minimizing Off-Target Cleavage Using Cas9 Nickase and Two Guide RNAs Cas9 is a RNA-guided DNA nuclease that may be targeted to specific locations in the genome with the help of a 20 bp RNA guide. However the guide sequence may tolerate some mismatches between the guide sequence and the DNA-target sequence. The flexibility is undesirable due to the potential for off-target cleavage, when the guide RNA targets Cas9 to a an off-target sequence that has a few bases different from the guide sequence. For all experimental applications (gene targeting, crop engineering, therapeutic applications, etc) it is important to be able to improve the specificity of Cas9 mediated gene targeting and reduce the likelihood of off-target modification by Cas9.

Applicants developed a method of using a Cas9 nickase mutant in combination with two guide RNAs to facilitate targeted double strand breaks in the genome without off-target modifications. The Cas9 nickase mutant may be generated from a Cas9 nuclease by disabling its cleavage activity so that instead of both strands of the DNA duplex being cleaved only one strand is cleaved. The Cas9 nickase may be generated by inducing mutations in one ore more domains of the Cas9 nuclease, e.g. Ruvc1 or HNH. These mutations may include but are not limited to mutations in a Cas9 catalytic domain, e.g in SpCas9 these mutations may be at positions D10 or H840. These mutations may include but are not limited to D10A, E762A, H840A, N854A, N863A or D986A in SpCas9 but nickases may be generated by inducing mutations at corresponding positions in other CRISPR enzymes or Cas9 orthologs. In a most preferred embodiment of the invention the Cas9 nickase mutant is a SpCas9 nickase with a D10A mutation.

The way this works is that each guide RNA in combination with Cas9 nickase would induce the targeted single strand break of a duplex DNA target. Since each guide RNA nicks one strand, the net result is a double strand break. The reason this method eliminates off-target mutations is because it is very unlikely to have an off-target site that has high degrees of similarity for both guide sequences (20 bp+2 bp(PAM)=22 bp specificity for each guide, and two guides means any off-target site will have to have close to 44 bp of homologous sequence). Although it is still likely that individual guides may have off-targets, but those off-targets will only be nicked, which is unlikely to be repaired by the mutagenic NHEJ process. Therefore the multiplexing of DNA double strand nicking provides a powerful way of introducing targeted DNA double strand breaks without off-target mutagenic effects.

Applicants carried out experiments involving the co-transfection of HEK293FT cells with a plasmid encoding Cas9(D10A) nickase as well as DNA expression cassettes for one or more guides. Applicants transfected cells using Lipofectamine 2000, and transfected cells were harvested 48 or 72 hours after transfections. Double nicking-induced NHEJ were detected using the SURVEYOR nuclease assay as described previously herein (FIGS. 51, 52 and 53).

Figure 54:
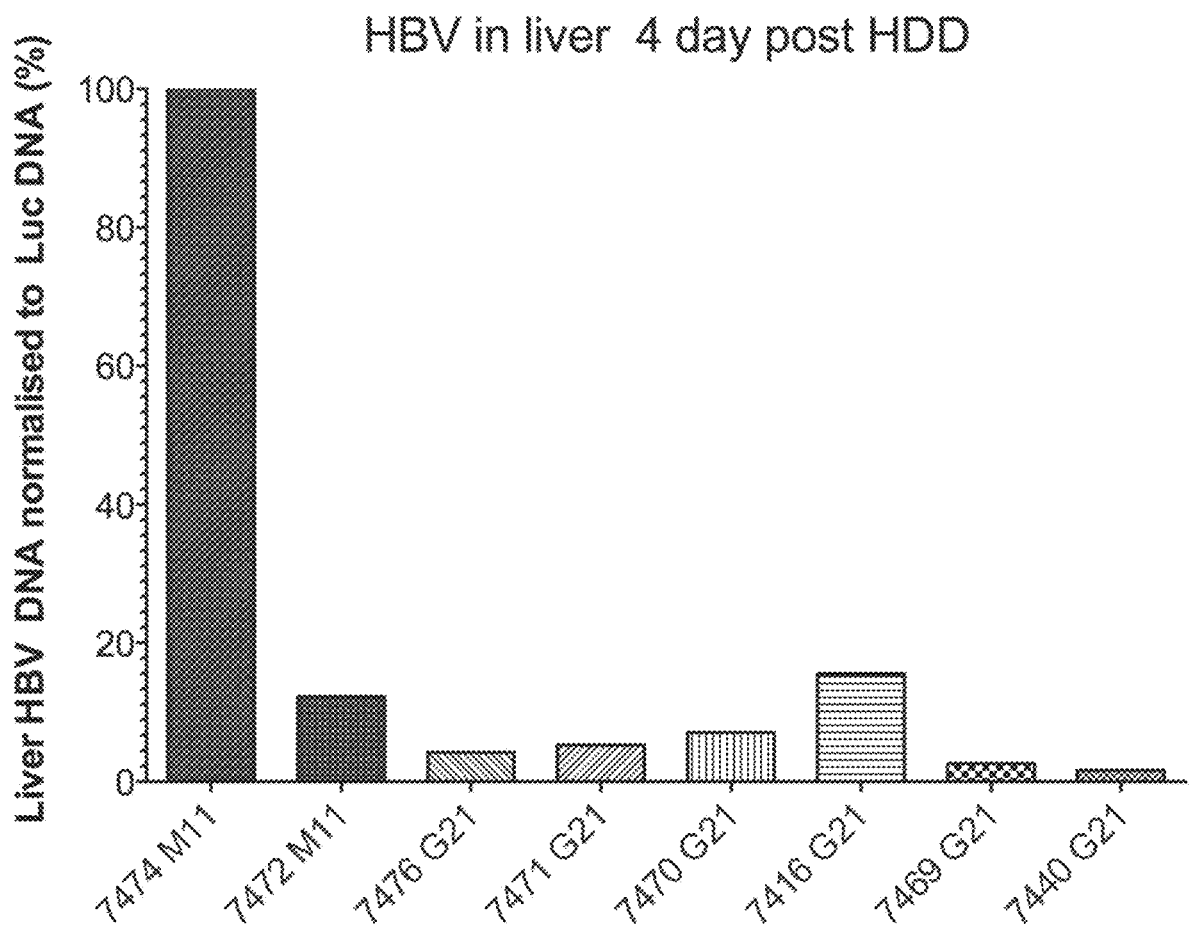
FIG. 54 shows HDD Cohort 3 Results: HBV in Liver
Figure 55:
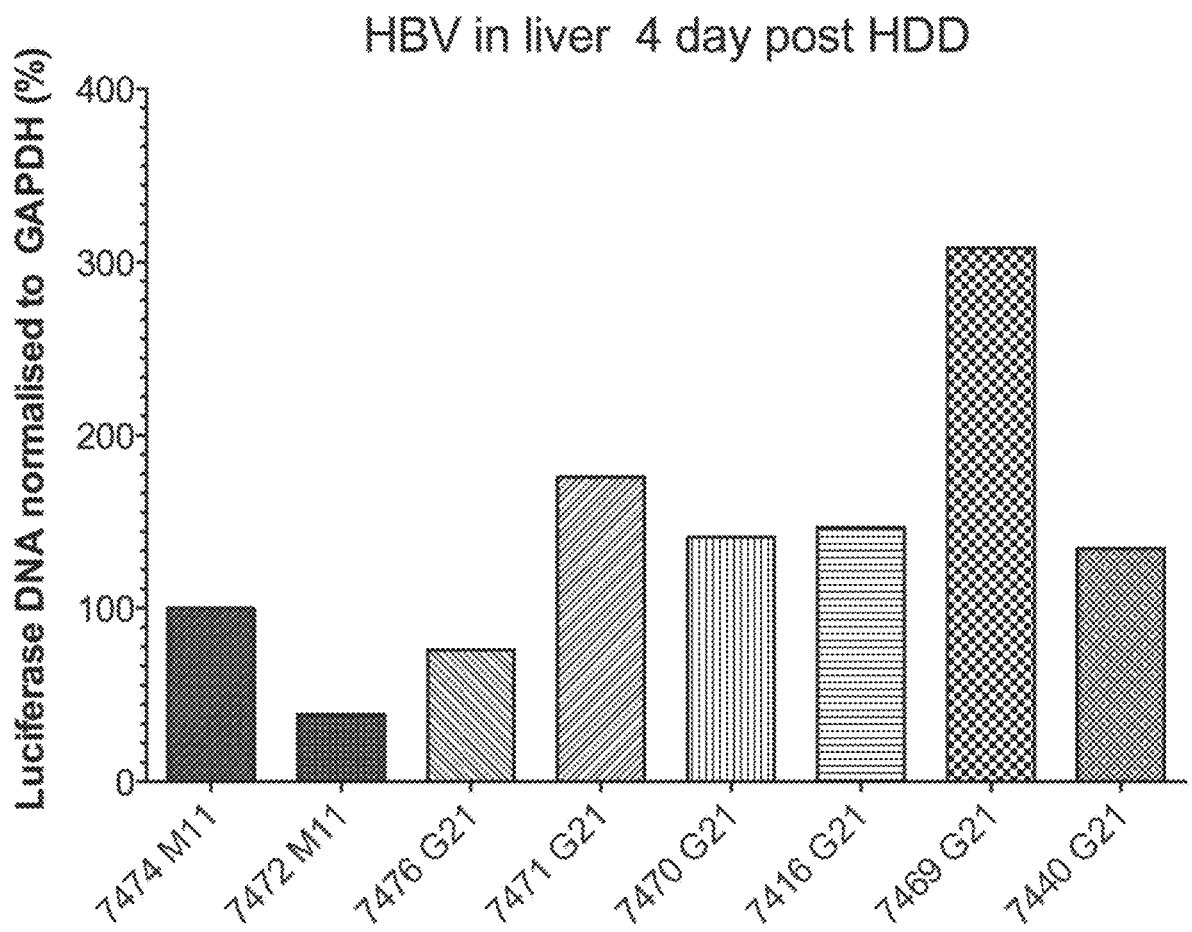
FIG. 55 shows HDD Cohort 3 Results: Luciferase normalized to GAPDH.

Applicants have further identified parameters that relate to efficient cleavage by the Cas9 nickase mutant when combined with two guide RNAs and these parameters include but are not limited to the length of the 5' overhang. Efficient cleavage is reported for 5' overhang of at least 26 base pairs. In a preferred embodiment of the invention, the 5' overhang is at least 30 base pairs and more preferably at least 34 base pairs. Overhangs of up to 200 base pairs may be acceptable for cleavage, while 5' overhangs less than 100 base pairs are preferred and 5' overhangs less than 50 base pairs are most preferred (FIGS. 54 and 55).

Example 28: CRISPR HBV

A CRISPR system has been designed for targeting the hepatitis B virus, as described herein and illustrated in FIGS. 36 to 72; and, this system has been demonstrated to be therapeutic.

Figure 40:
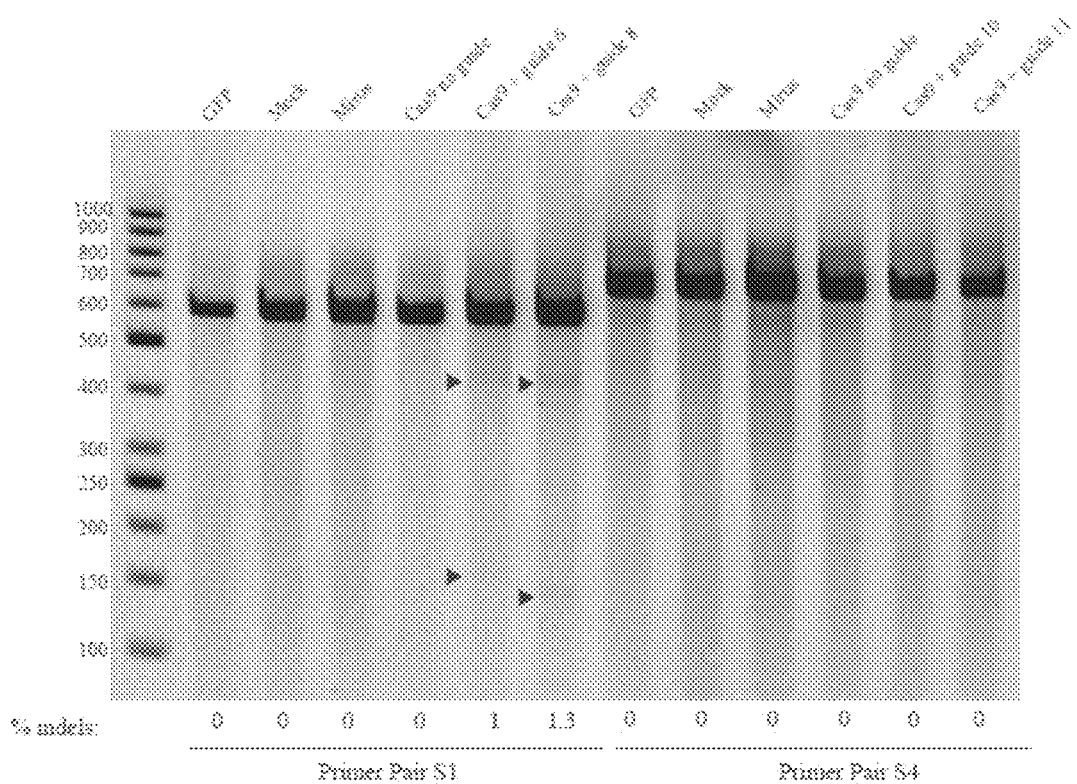
FIG. 40 shows representative surveyor for 1st set of HepG2.2.15 experiments.
Figure 41:
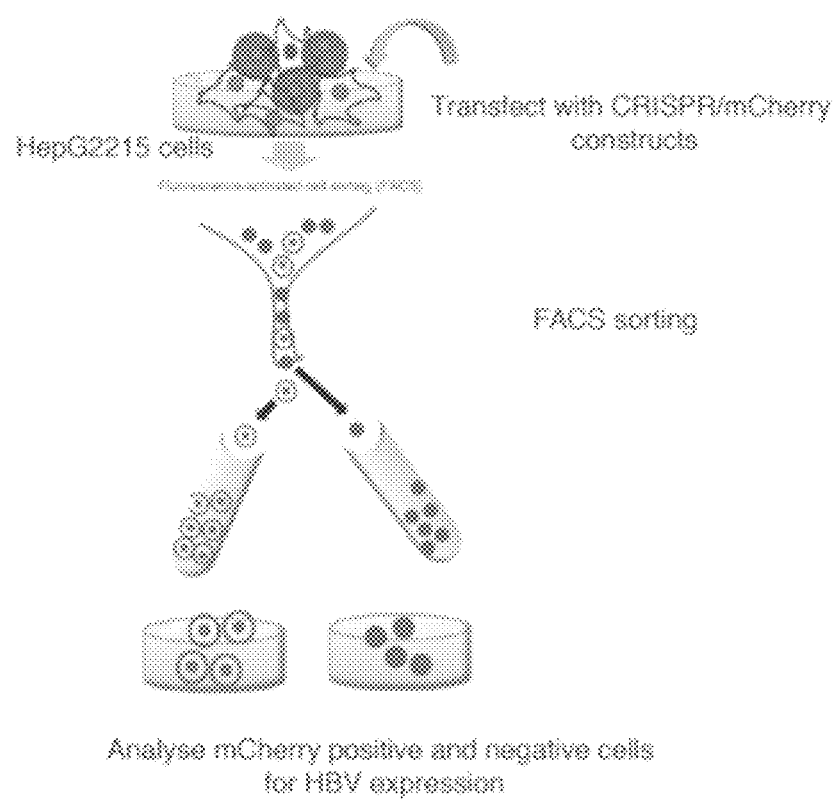
FIG. 41 shows HepG2.2.15 HBV quantification scheme, an experimental design motivated by noise of initial data sets.
Figure 43:
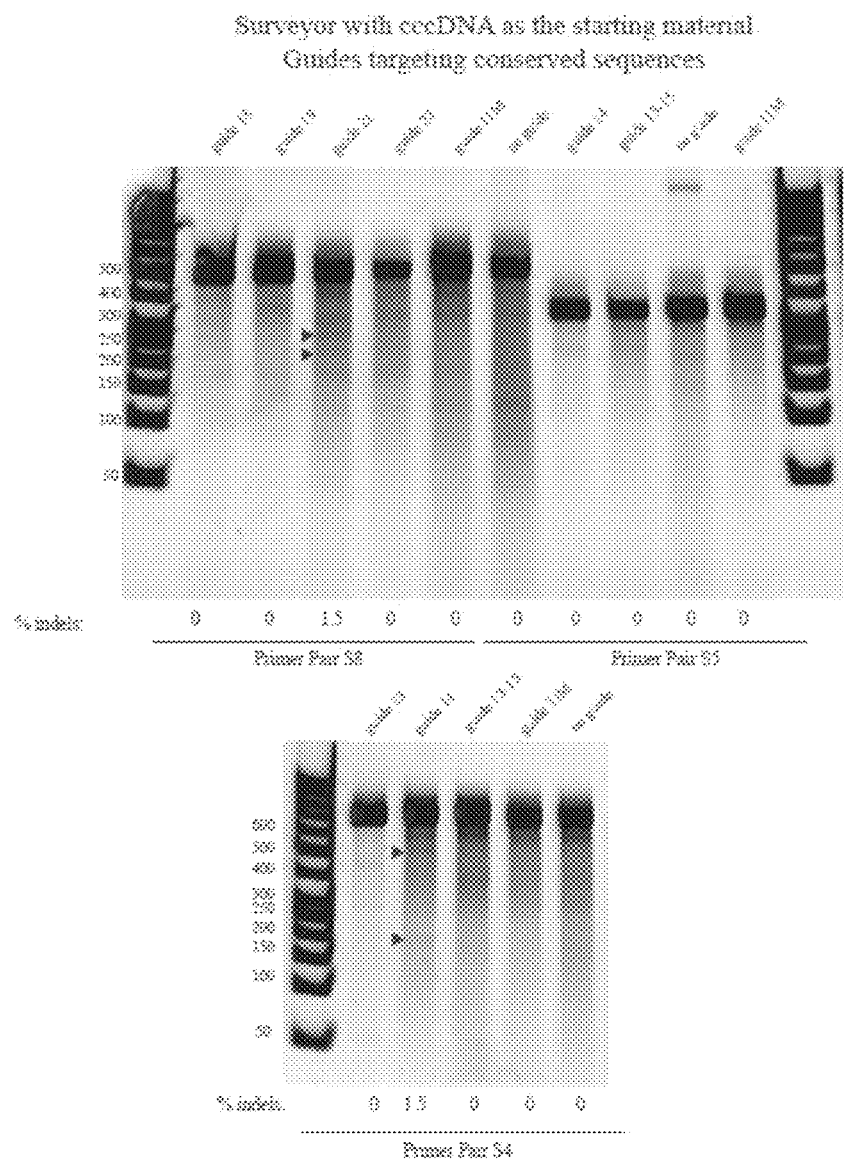
FIG. 43 shows low levels of indels observed with guides targeting conserved HBV sequences in 2nd round of HepG2.2.15 experiments.
Figure 46:
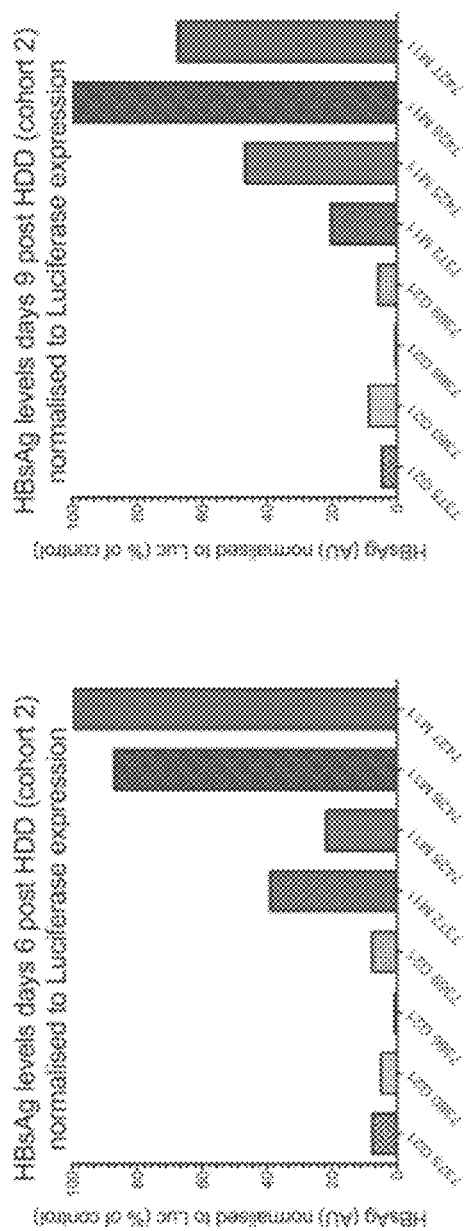
FIG. 46 shows HDD data for Cohort 2.
Figure 47:
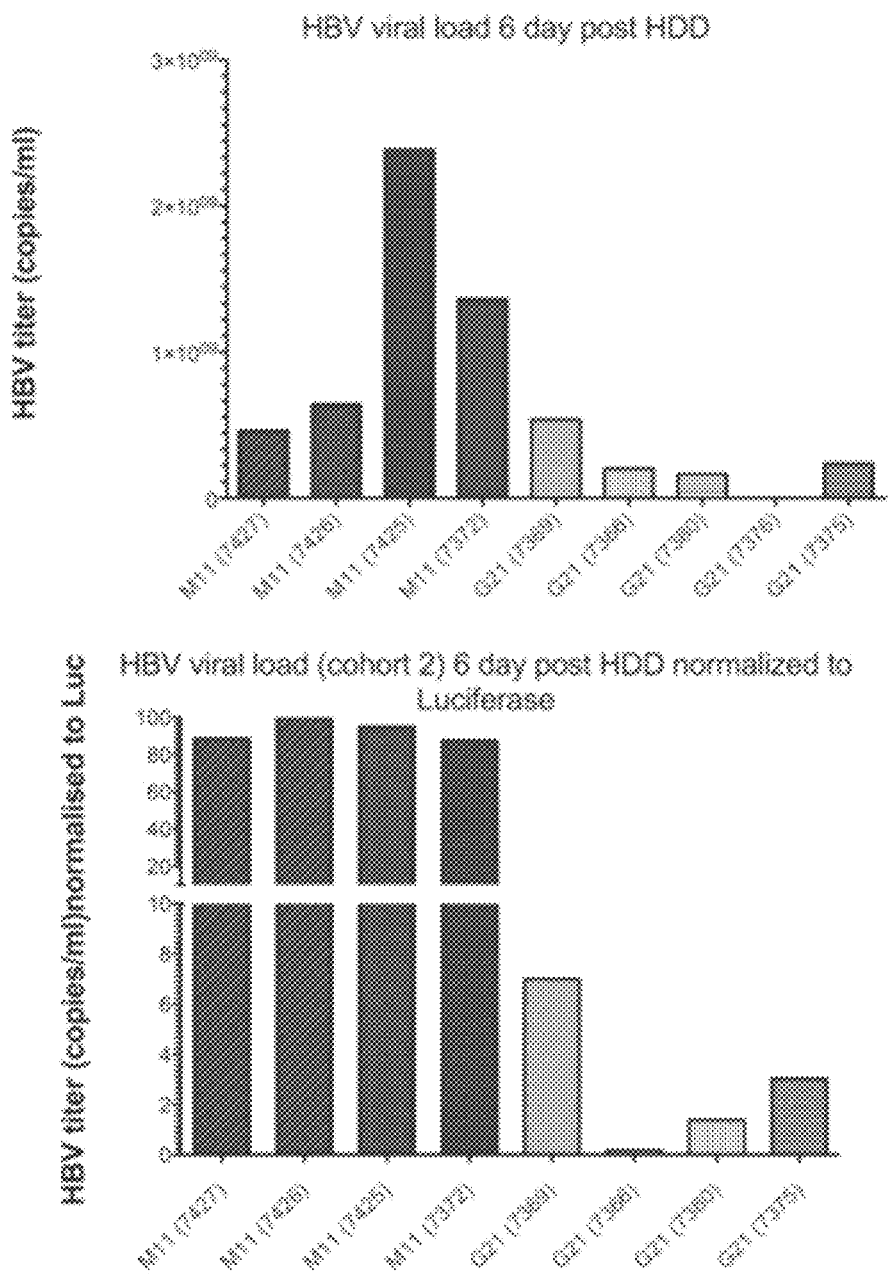
FIG. 47 shows HDD data for Cohort 2.
Figure 48:
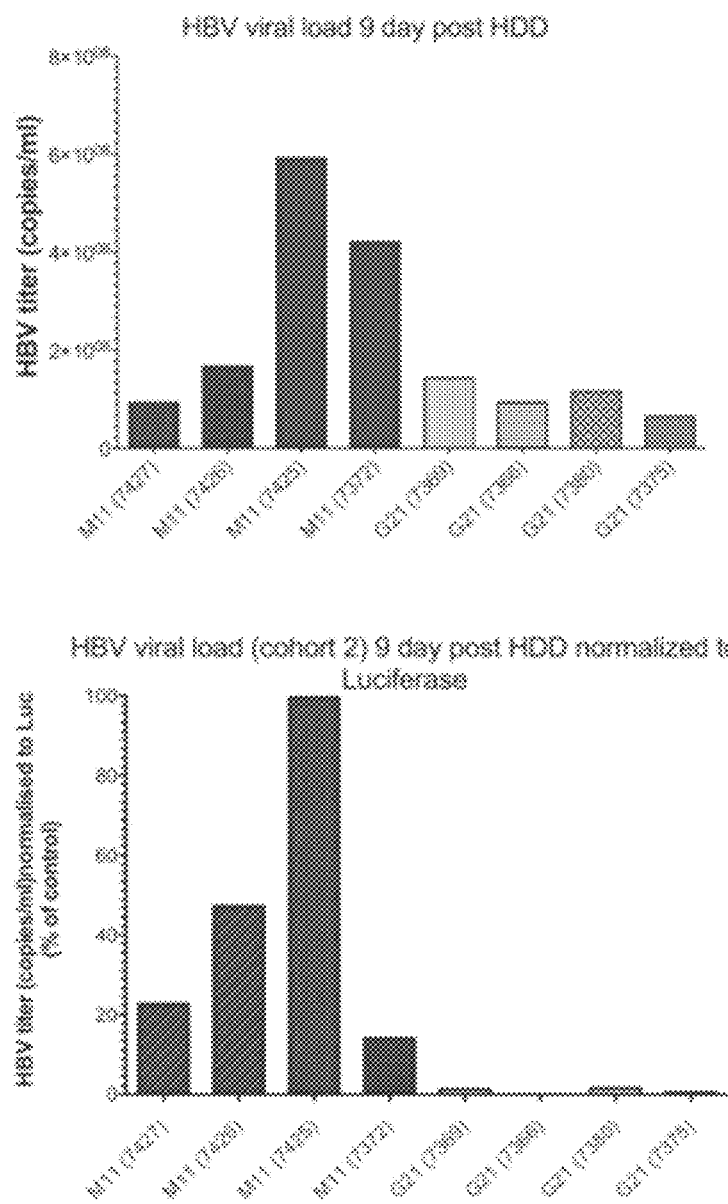
FIG. 48 shows HDD data for Cohort 2.
Figure 49:
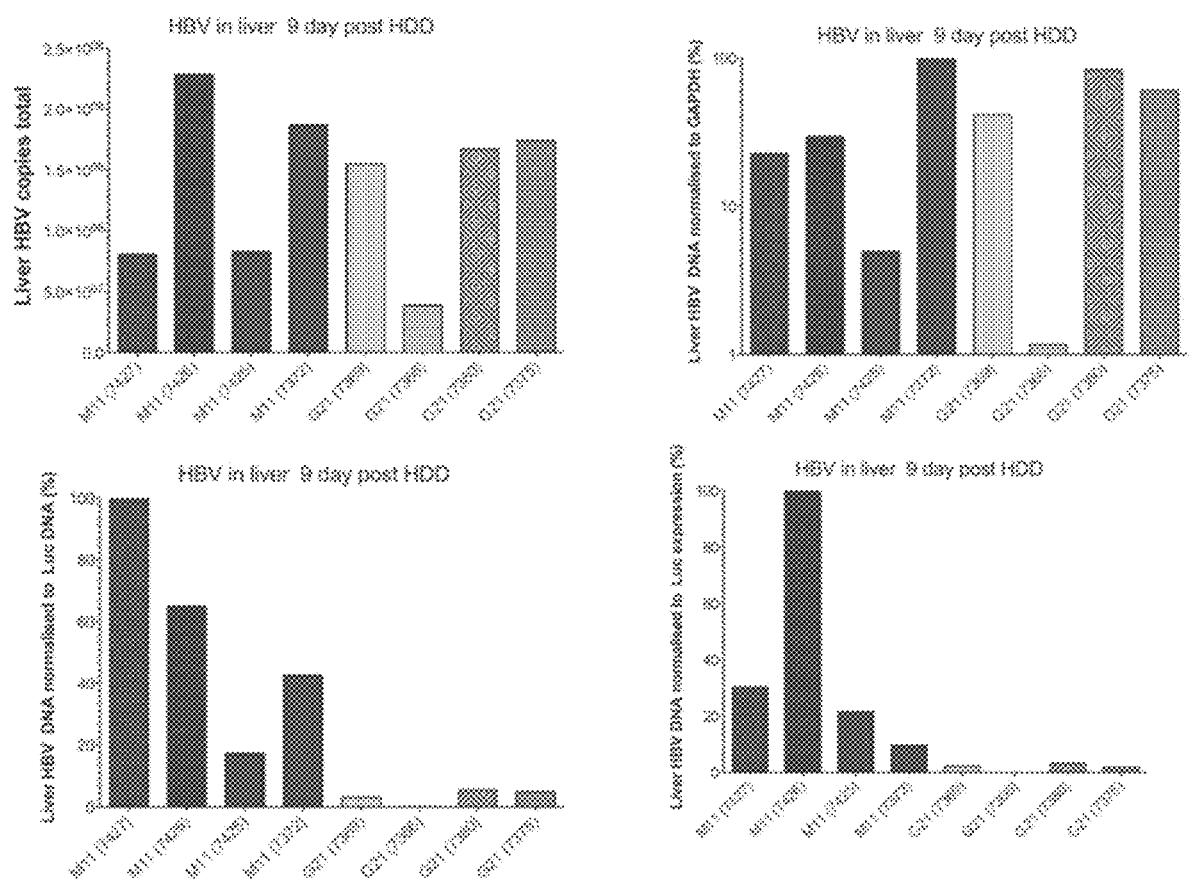
FIG. 49 shows Cohort 2-liver analysis 9d post HDD.
Figure 51:
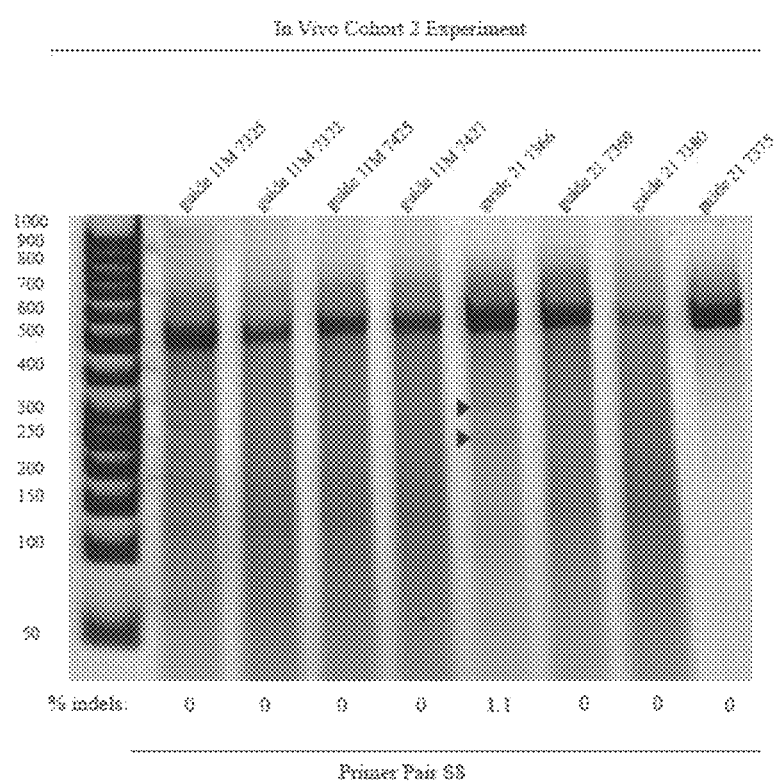
FIG. 51 shows low/no indels formed during HDD experiments. Predicted band sizes for guide 21 formation: 235+272+507 bp (undigested PCR product).
Figure 52:
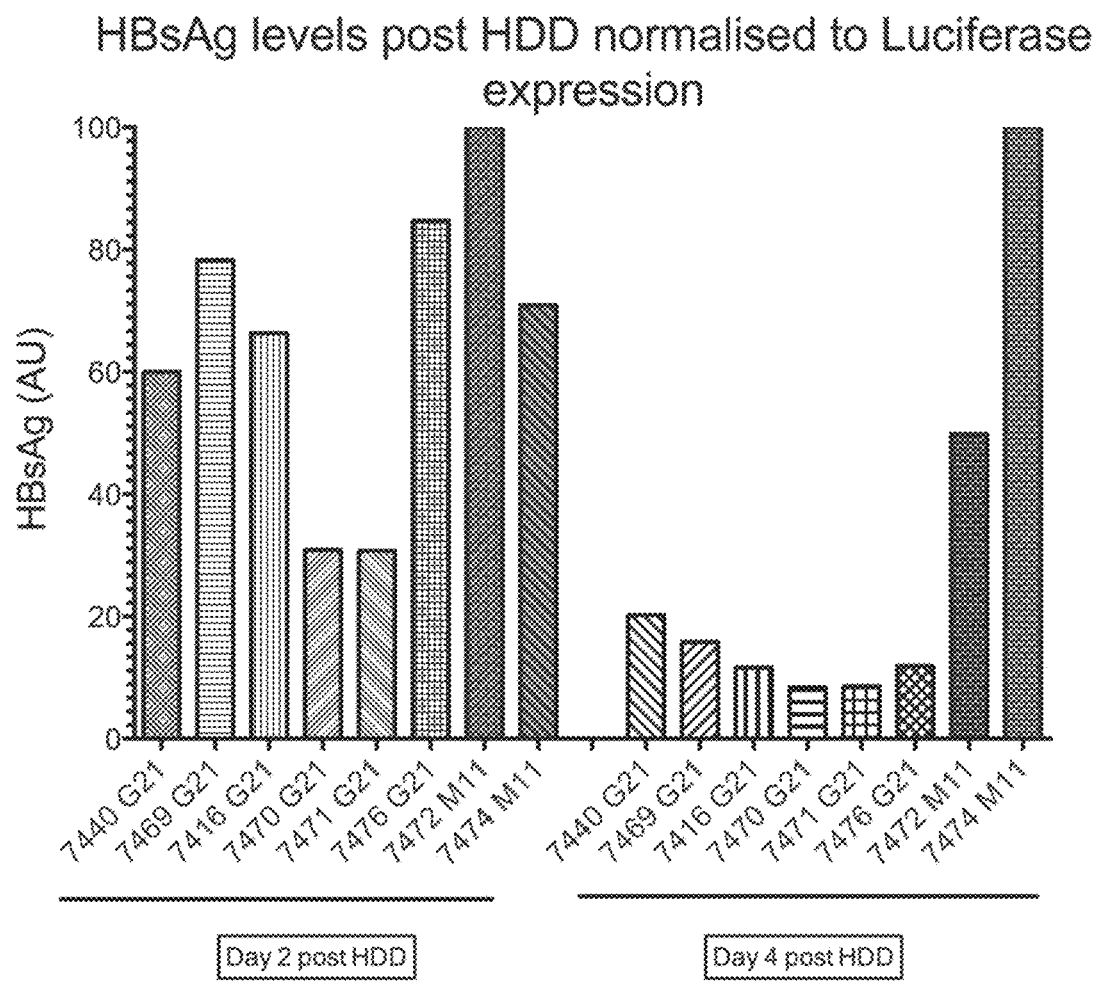
FIG. 52 shows HDD Cohort 3 Results: HBsAg.
Figure 53:
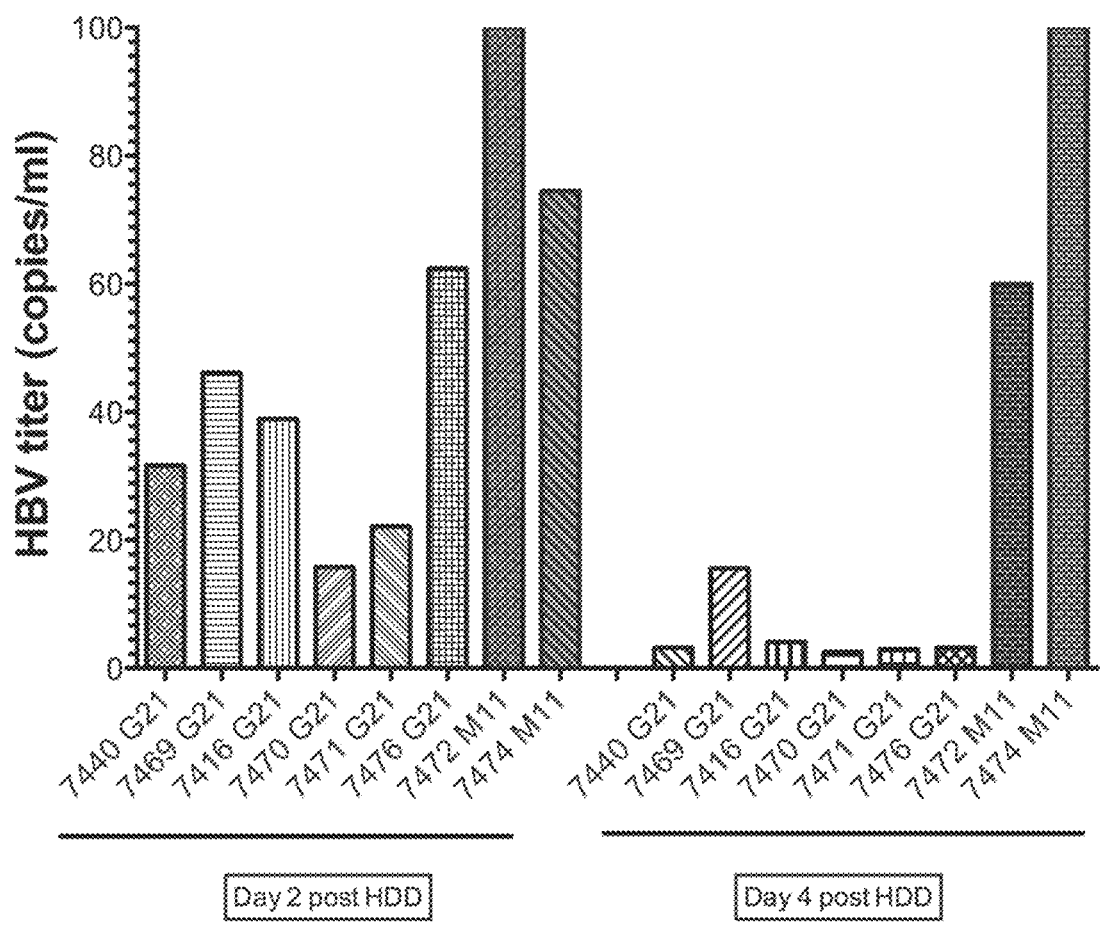
FIG. 53 shows HDD Cohort 3 Results: Viremia.
Figure 56:
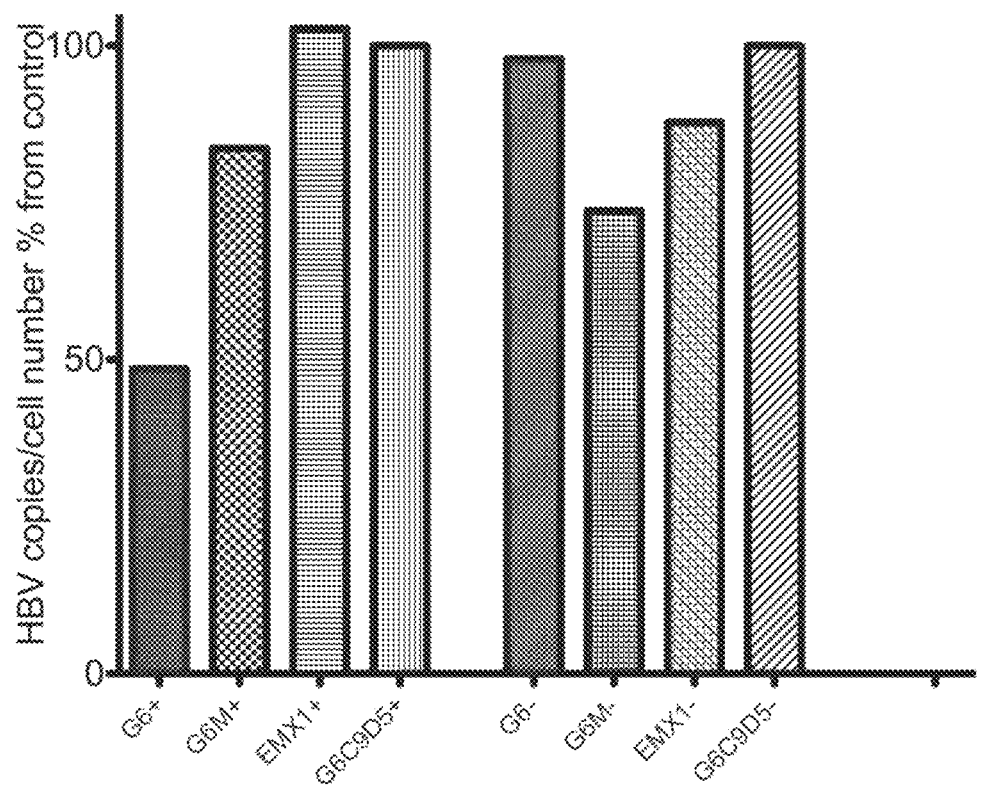
FIG. 56 shows despite low/no indel formation, effects on HBV are dependent on Cas9 nuclease activity.
Figure 60A:
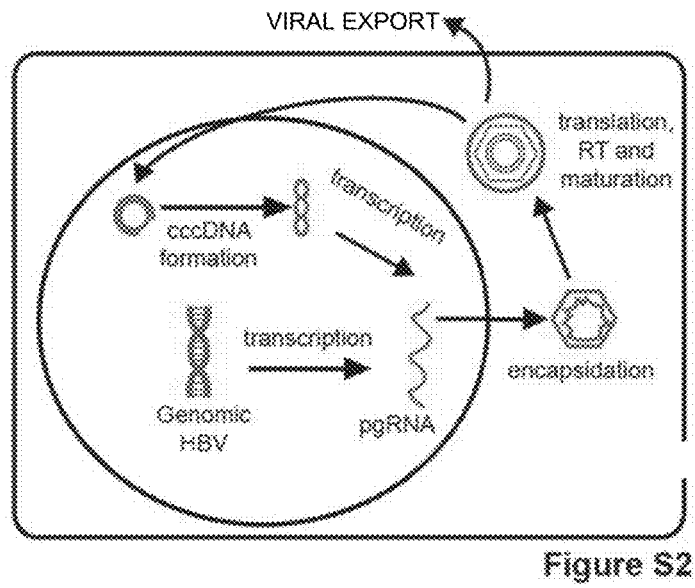
FIG. 60A-B shows (a) the HBV life cycle within HepG2.2.15 cells. HepG2.2.15 cells contain genomically integrated linear 1.3× WT HBV sequences, from which viral proteins and cccDNA are constitutively produced via transcription followed by translation (proteins) or reverse transcription and nuclear re-import (cccDNA). The persistent HBV production in this system enables assay of the long-term anti-HBV effects of CRISPR/Cas systems targeting viral DNA; and (b) schematic of lentiviral vector and experimental strategy for sustained CRISPR expression within HepG2.2.15 cells.
Figure 60B:
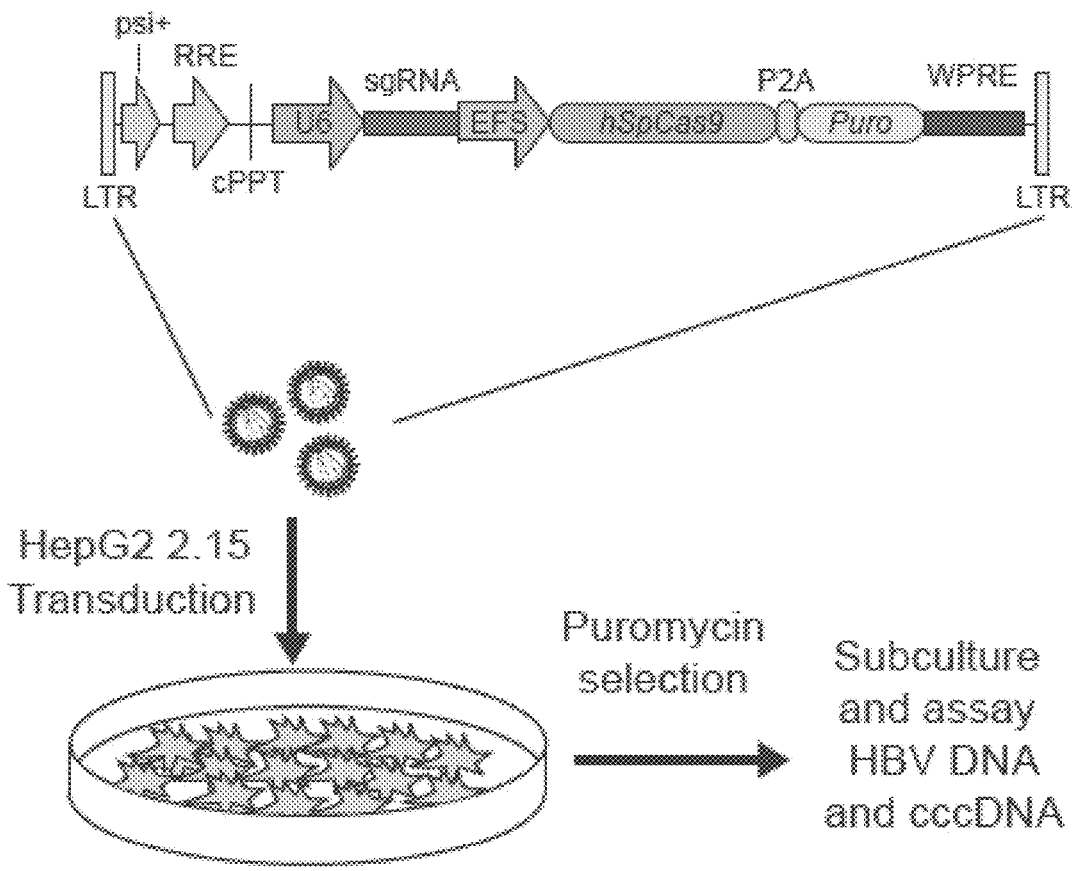
Figure 61A:
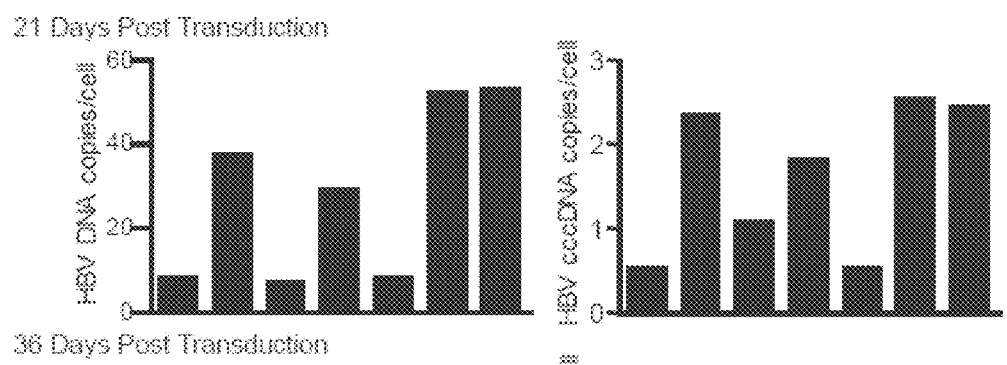
FIG. 61A-B shows that HBV-targeting CRISPR reduces HBV DNA and cccDNA dependent upon HBV-specific guide RNA and Cas9 activity.
Figure 61B:
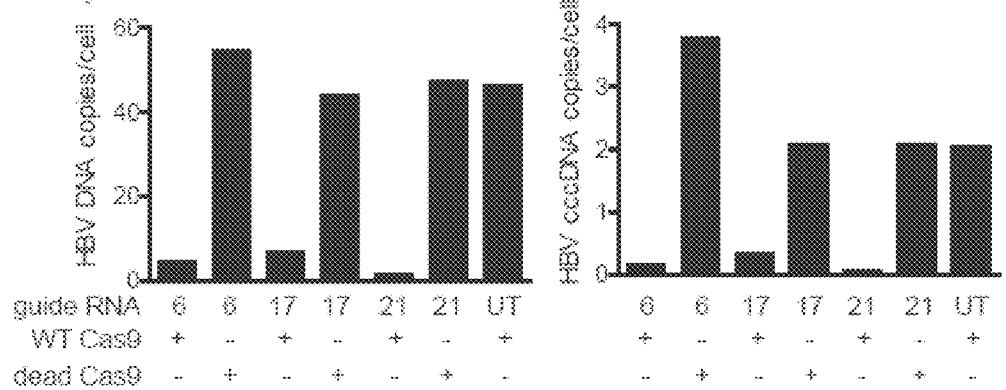
Figure 62A:
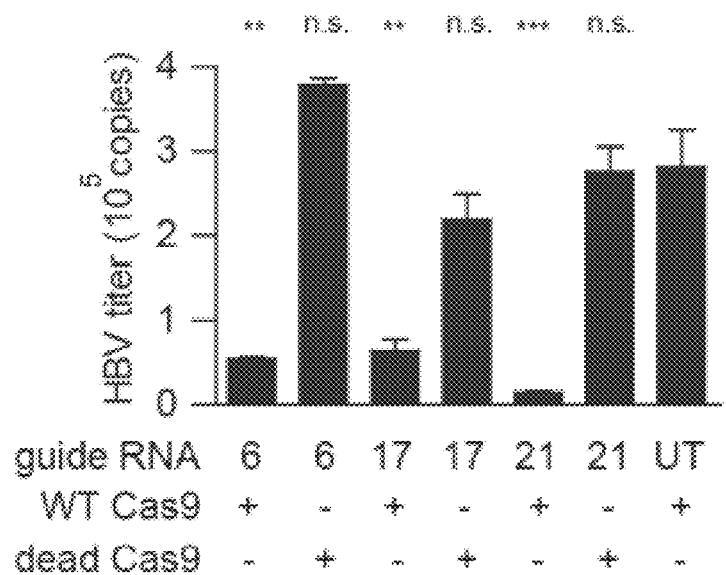
FIG. 62A-C shows HBV products are reduced upon long-term CRISPR/Cas expression. Stable lines of HepG2.2.15 cells expressing 3 different on-target guides with nuclease-active or nuclease-dead Cas9, along with 3 non-HBV targeting guides, were seeded at consistent cell densities (20,000 cells/cm2) and allowed to secrete virions and viral proteins into the supernatant. 72 h later, supernatant was collected and (a) viral titer and (b) HBeAg (a secreted protein produced from the C ORF, used clinically as a marker of active viral replication) were quantified (c). Total HBV RNA and 3.5 kb RNA (consisting of pregenomic RNA and the longest translated HBV RNA species, which are difficult to distinguish) were quantified at 36 days post transduction, with HBV RNA suppression continuing out to this late time point. (a-b) *p<0.05 vs. UT; p<0.01 vs. UT; *p<0.001 vs. UT as assessed by one-way ANOVA followed by Dunnett's post-hoc test.
Figure 62B:
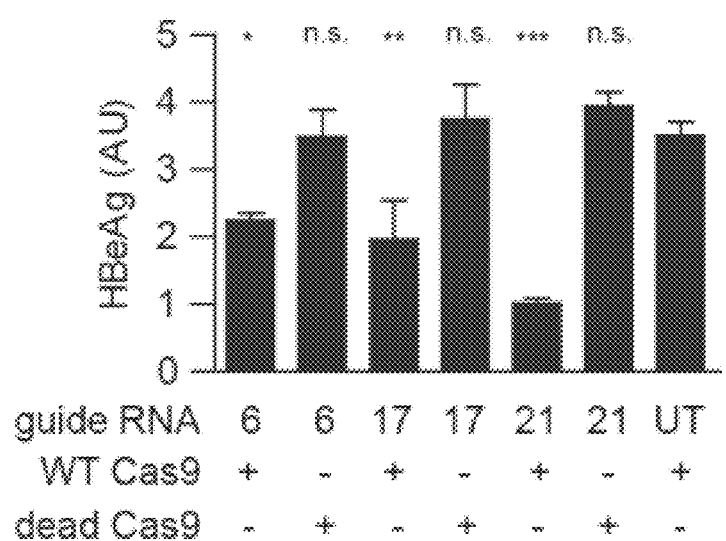
Figure 62C:
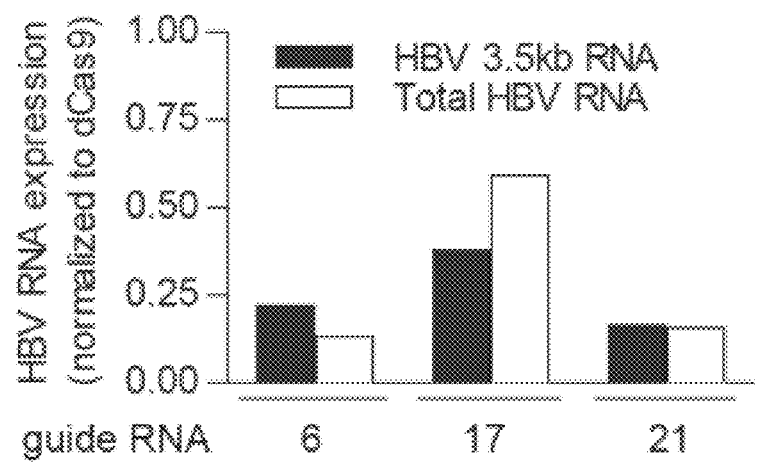
Figure 63A:
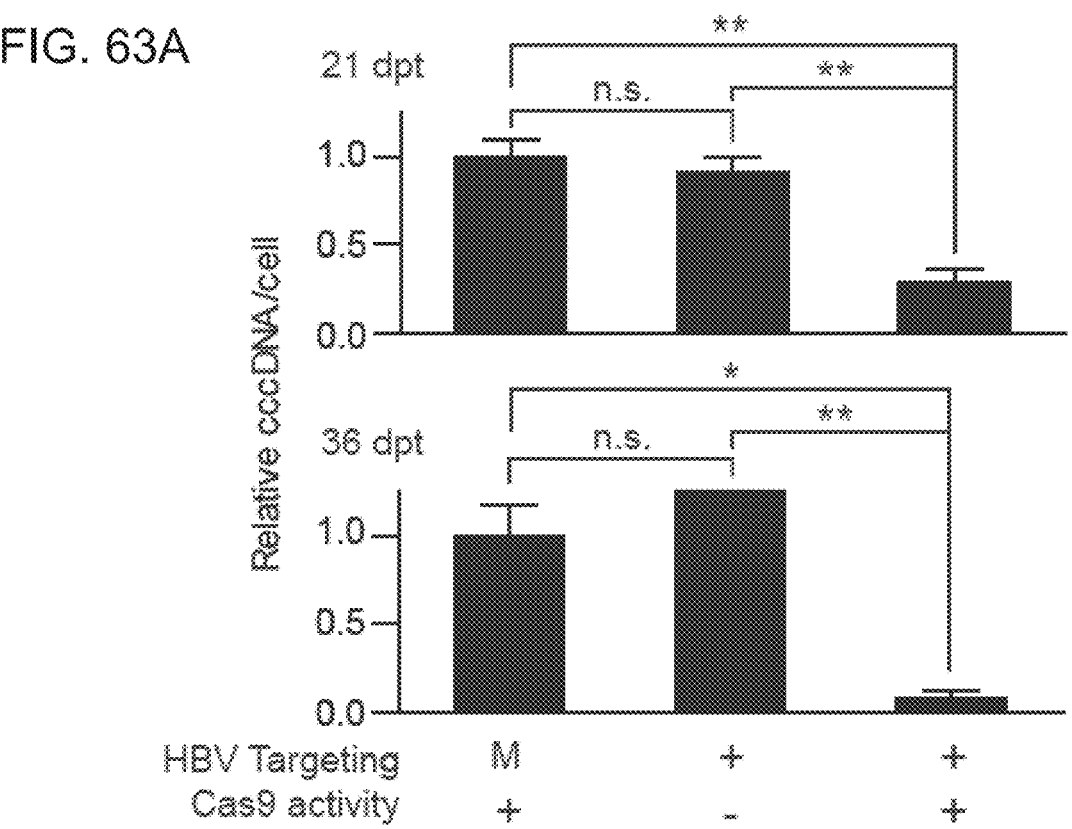
FIG. 63A-B shows that CRISPR constructs targeting HBV cause large and progressive reduction in (a) cccDNA and (b) total HBV DNA levels that is dependent on successful targeting of viral DNA.
Figure 63B:
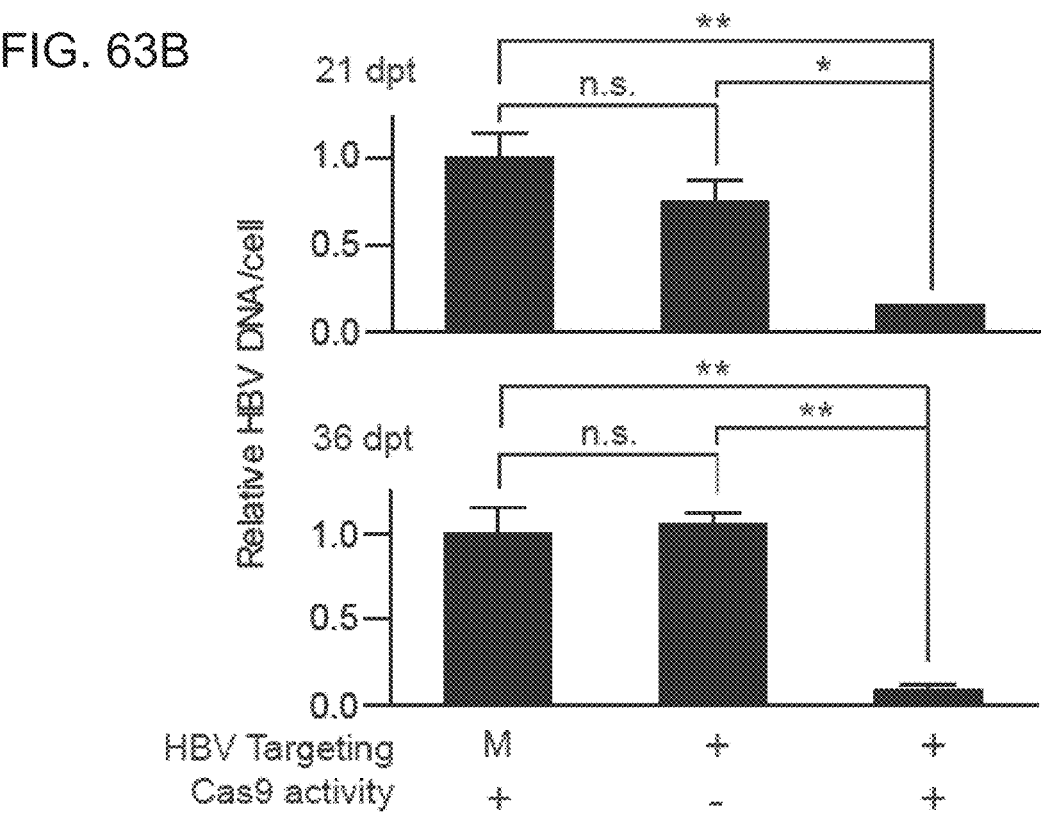
Figure 65:
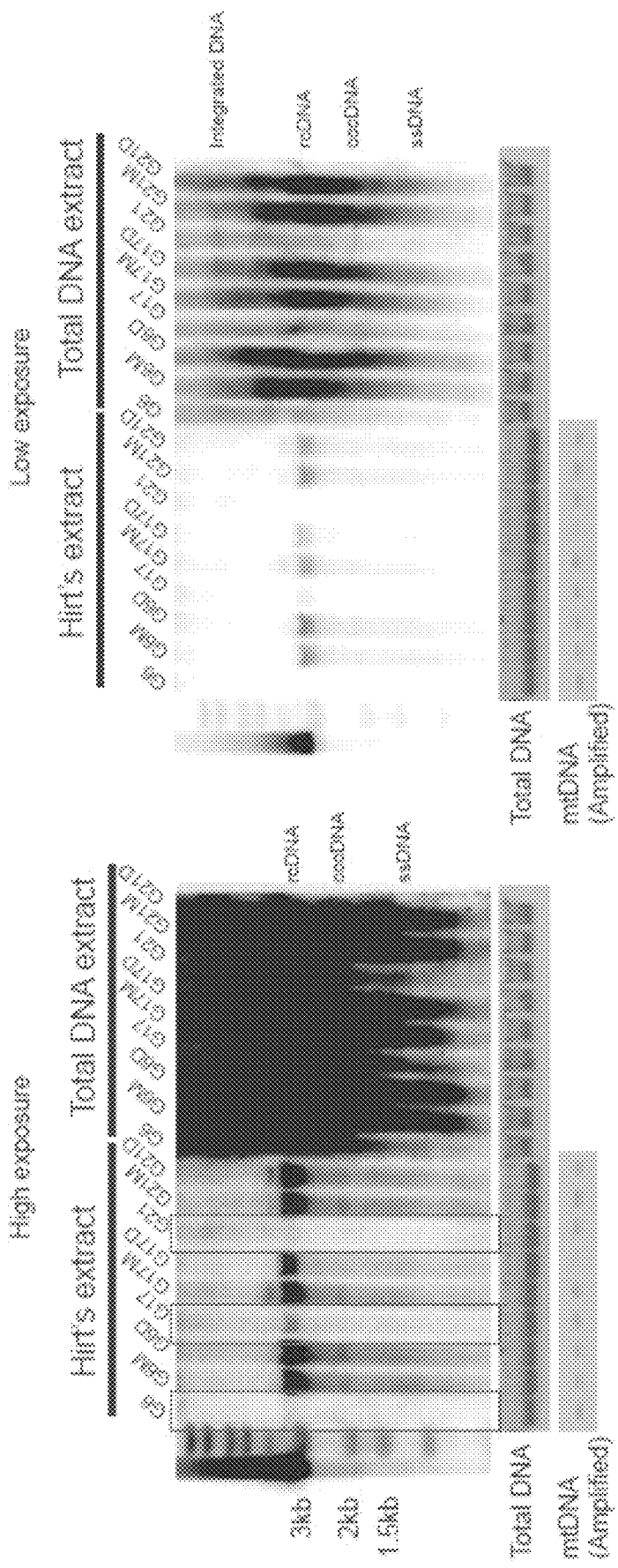
FIG. 65 shows Southern blot of HBV DNA.
Figure 66:
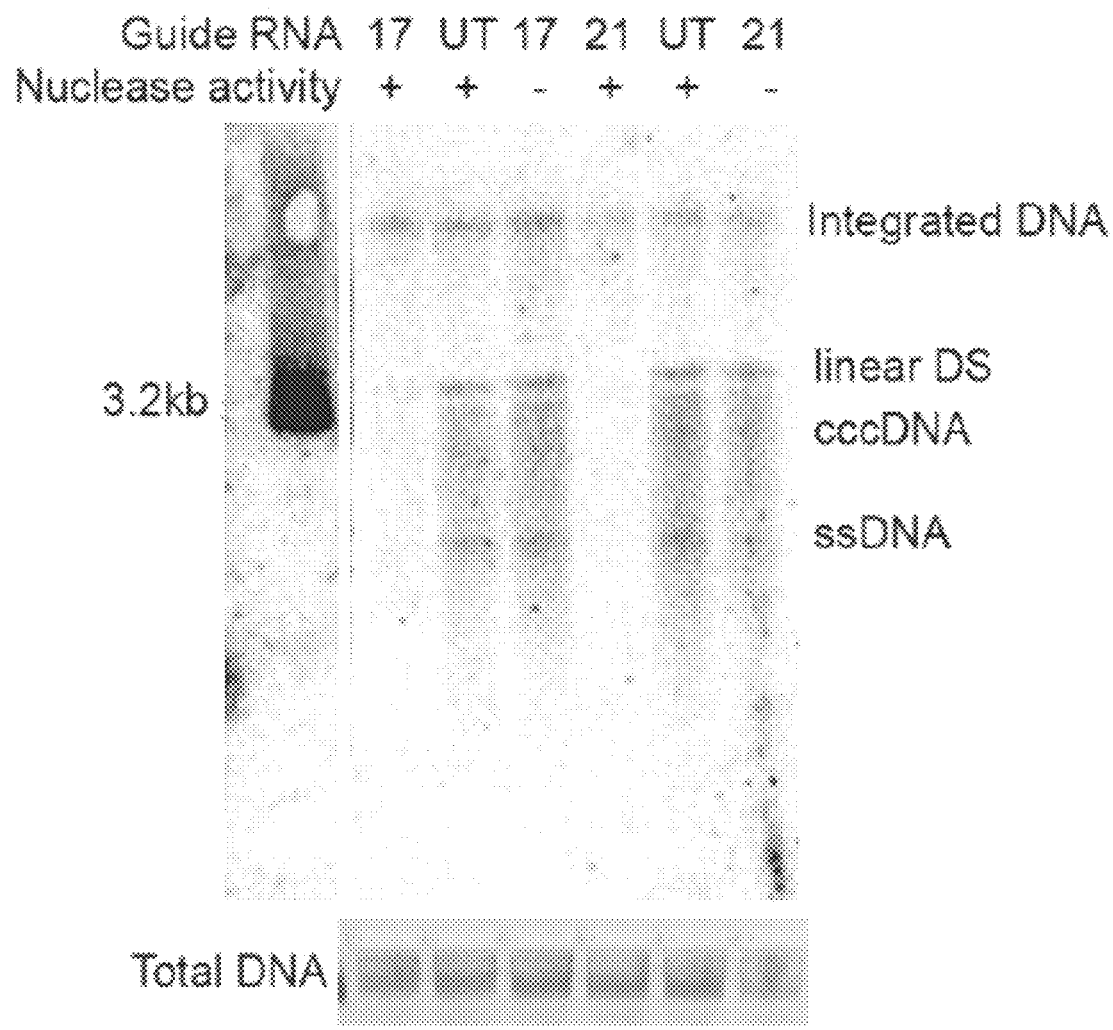
FIG. 66 shows Southern blot of HBV DNA.
Figure 67:
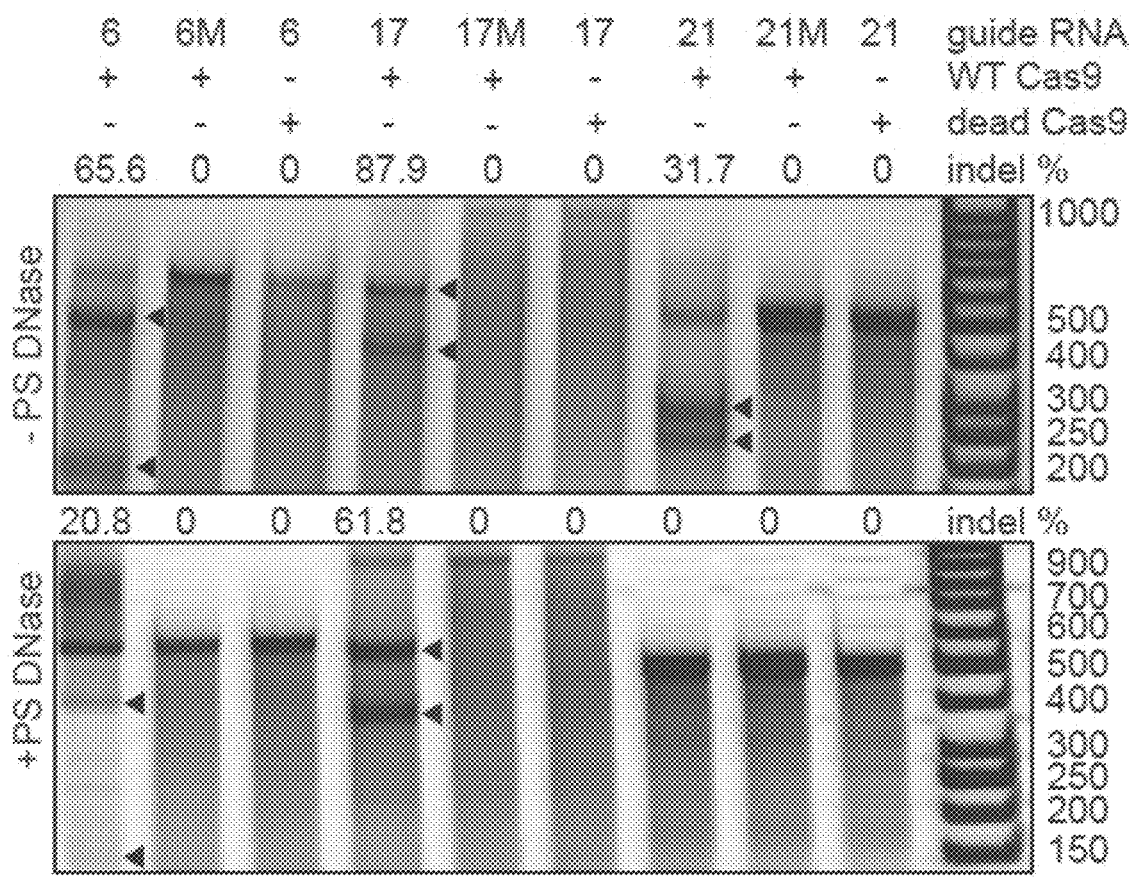
FIG. 67 shows Surveyor assay to detect indel formation in total HBV DNA (top) and episomal HBV DNA, enriched by treatment with plasmid-safe DNase (bottom); lentiviral transduction enables high levels of cutting of HBV. Arrowheads depict surveyor digestion products resulting from indel formation. Expected PCR product sizes for g6, g17 and g21 are respectively 599, 946 and 507 bp. Approximate sizes of surveyor digestion products for g6, g17 and g21 are respectively: 429+170, 570+376, 275+232.
Figure 68:
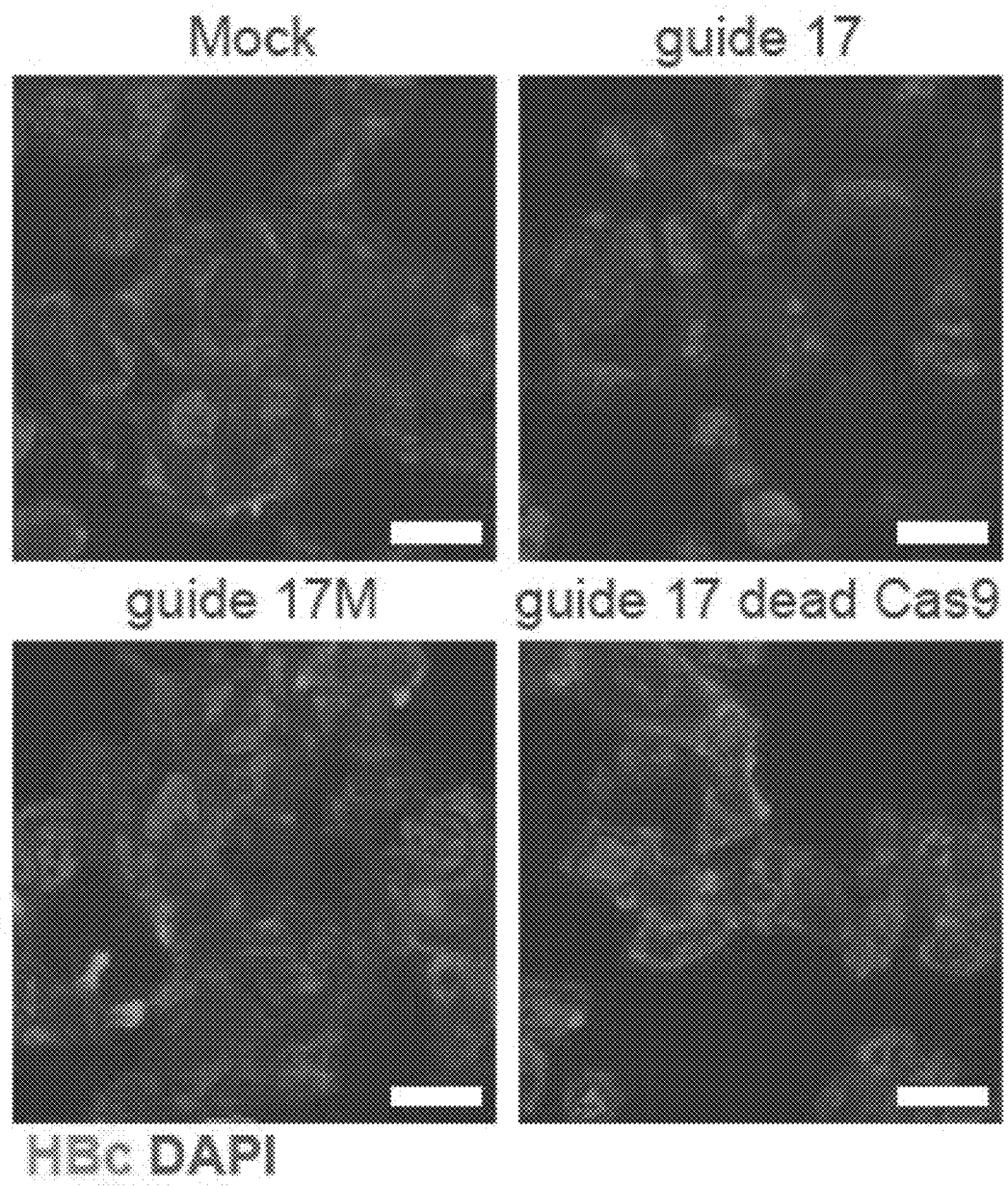
FIG. 68 shows Immunofluorescent imaging of HBV Core protein demonstrates large reduction in Core staining upon targeting by g17 specifically against the Core ORF.
Figure 69:
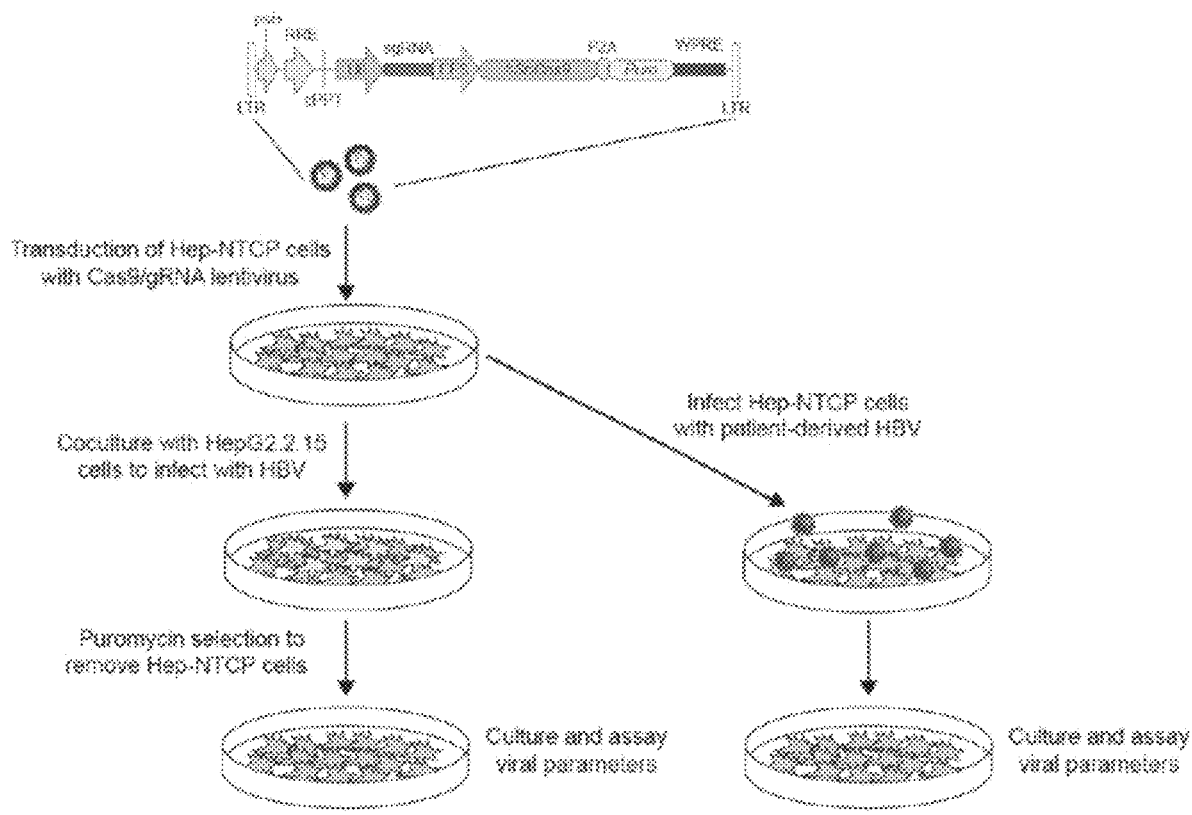
FIG. 69 shows schematics for de novo infection experiments. Hep-NTCP cells were transduced with Cas9/gRNA constructs containing either g17 or g17M (mutant of g17, resulting in 5 bp DNA bulge upon complexation to HBV DNA target), and either WT or dead Cas9, and then selected with puromycin to generate stable lines. (Left) These cells were seeded in coculture with HepG2.2.15 cells, which produce infectious HBV virions that then infect the transduced Hep-NTCP cells. After transient coculture, HepG2.2.15 cells were killed by puromycin selection, and Hep-NTCP cells were cultured for several days and then harvested to assay viral parameters. (Right) These cells were infected with HBV virions derived from HBV+ patient plasma, then cultured and harvested to assay viral parameters.
Figure 70A:
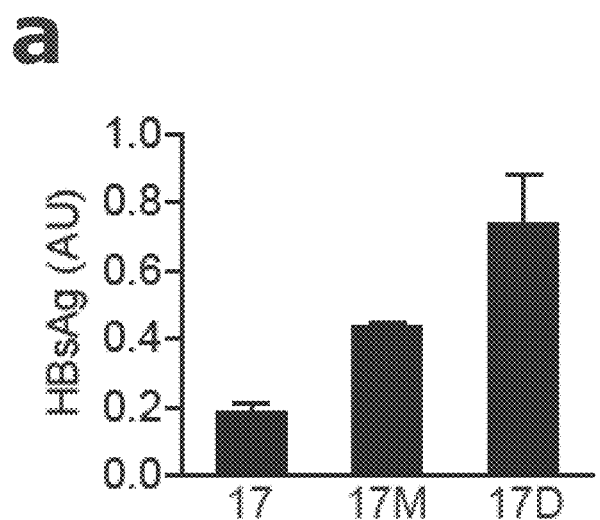
FIG. 70A-D shows HBsAg secretion (a), cccDNA copies (b), levels of HBV 3.5 kb RNA relative to 5 bp mismatch control (c), and titer of HBV DNA in culture medium (d). The data show that Cas9/g17 reduce HBV infection in de novo infection context. 17M: 5 bp mismatch control. 17D: dead Cas9 with g17. Data shown are from one representative experiment, and consistent across experiments.
Figure 70B:
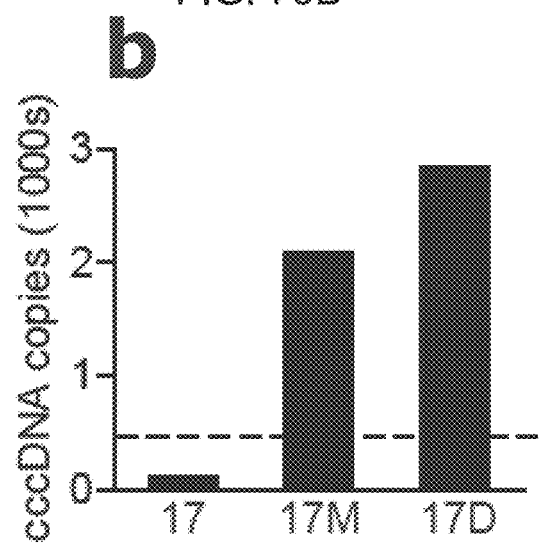
Figure 70C:
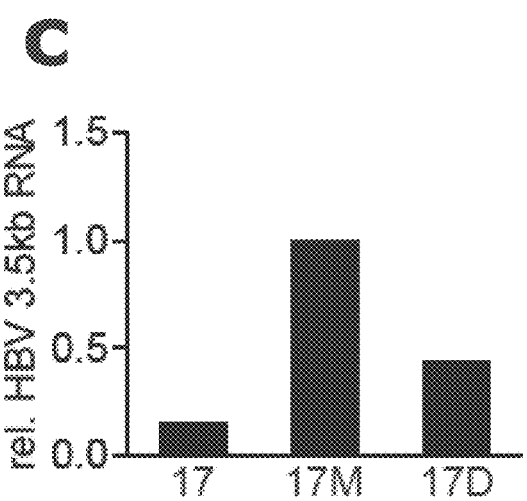
Figure 70D:
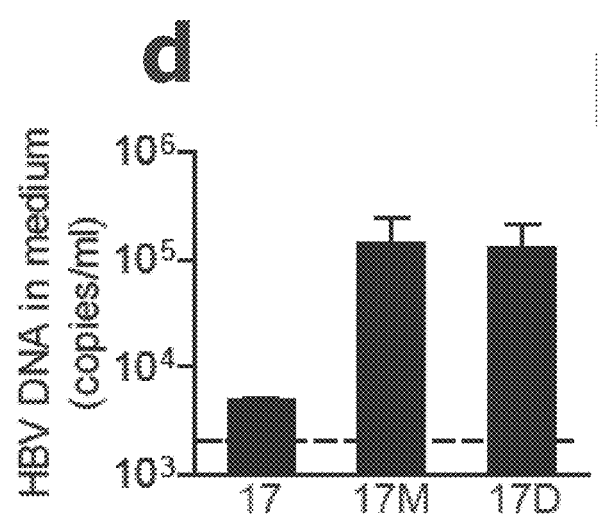
Figure 71A:
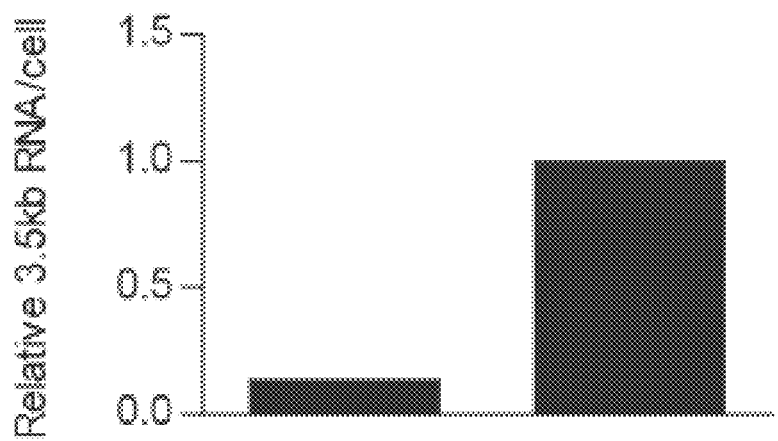
FIG. 71A-C shows CRISPR/Cas-mediated disruption of HBV in patient-derived virus model system. Hep-NTCP cells were infected with HBV from infected patient serum upon transduction of guide 17 and active or nuclease-dead Cas9. 9 days after infection, the cells were harvested and viral products were quantified. Nuclease-active Cas9 caused decreases in HBV 3.5 kb RNA (a), cccDNA (b), and total DNA levels (c).
Figure 71B:
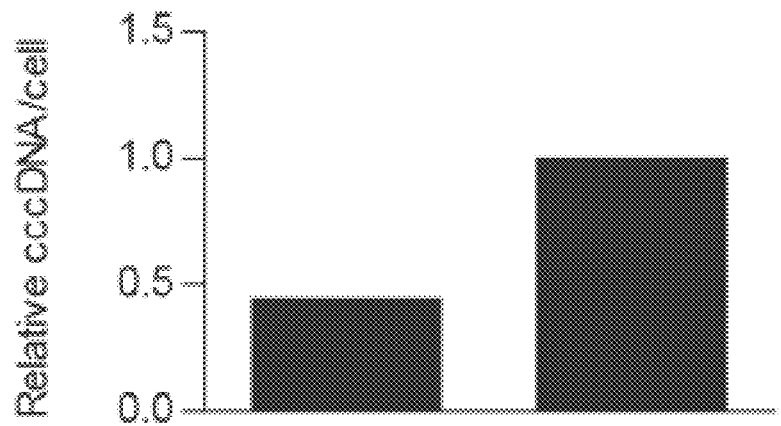
Figure 71C:
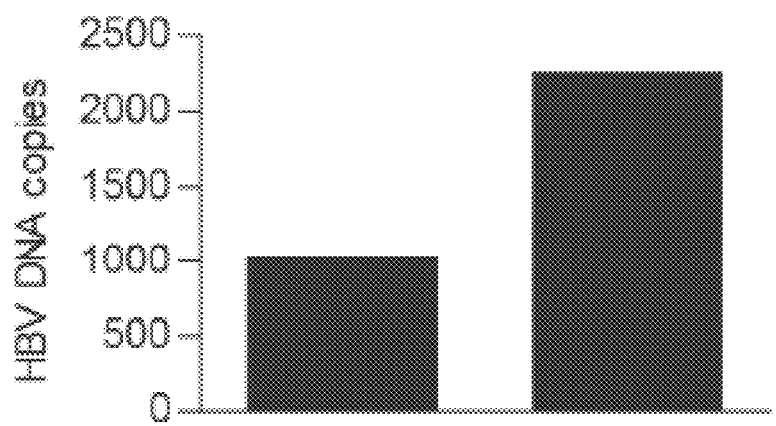
Figure 72:
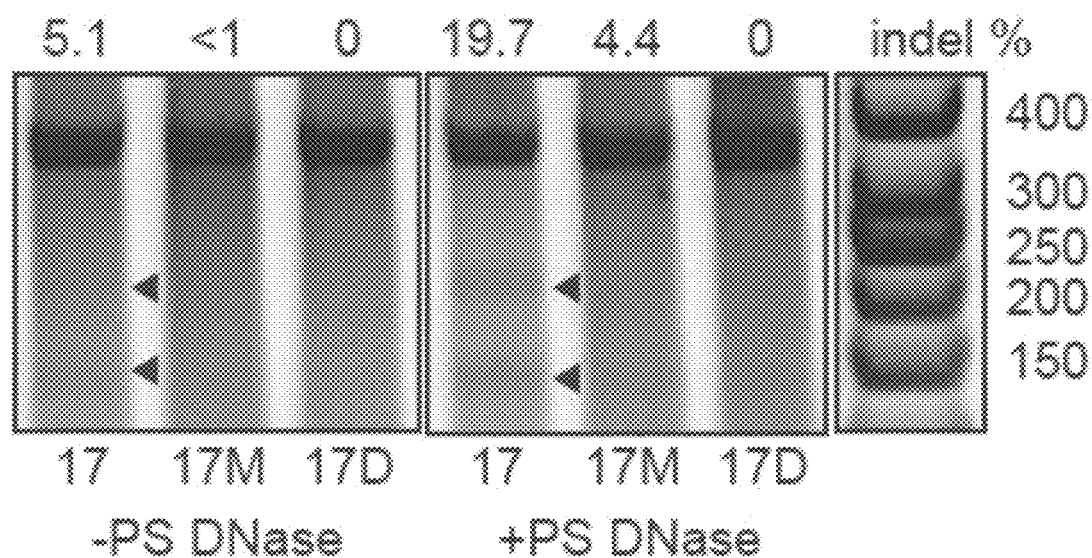
FIG. 72 shows Surveyor assay performed on DNA untreated (left) or treated (right) with plasmid-Safe DNase to remove non-episomal viral forms. Arrowheads indicate shorter amplicons resulting from indel formation. The low levels of indel formation in 17M likely result from inefficient cutting enabled by the 5 bp bulge between target DNA and gRNA, recently appreciated in Lin, Y et al., (2014). (b-c) *$p<0.05$ for selected comparison; **$p<0.01$ for selected comparison, as assessed by one-way ANOVA with Tukey post-hoc test.

The Figures associated with this Example are FIGS. 36 to 72, with FIGS. 36 and 57 demonstrating guide design. FIG. 38 shows qPCR results from 1st round of HepG2.2.15 experiments. FIG. 39 shows a Surveyor assay for nuclease activity. Indels form as the result of imperfect NHEJ events due to repeated DSB formation from nuclease activity. For Cas9 targeted genomic loci indel formation at rates 10-30% are often observed and can approach 50%. FIG. 40 shows representative surveyor for 1st set of HepG2.2.15 experiments. FIG. 41 shows HepG2.2.15 HBV quantification scheme, an experimental design motivated by noise of initial data sets. FIG. 42 shows HepG2.2.15 results using sorting based normalization. FIG. 43 shows low levels of indels observed with guides targeting conserved HBV sequences in 2nd round of HepG2.2.15 experiments. FIG. 44 shows HepG2 co-transfection experiments. FIG. 45 shows HDD data for Cohort 1. FIG. 46 shows HDD data for Cohort 2. FIG. 47 shows HDD data for Cohort 2. FIG. 48 shows HDD data for Cohort 2. FIG. 49 shows Cohort 2-liver analysis 9d post HDD. FIG. 50 shows Cohort 2-liver analysis 9d post HDD. FIG. 51 shows low/no indels formed during HDD experiments. Predicted band sizes for guide 21 formation: 235+272+507 bp (undigested PCR product). FIG. 52 shows HDD Cohort 3 Results: HBsAg. FIG. 53 shows HDD Cohort 3 Results: Viremia. FIG. 54 shows HDD Cohort 3 Results: HBV in Liver. FIG. 55 shows HDD Cohort 3 Results: Luciferase normalized to GAPDH. FIG. 56 shows despite low/no indel formation, effects on HBV are dependent on Cas9 nuclease activity. FIG. 57 shows schematic of HBV life cycle and putative anti-HBV effect of CRISPR constructs as well as HBV genome organization and location of target sequences for several tested guide RNA constructs. FIG. 58 shows guide RNAs targeting conserved regions target large majority of patient-derived virus genomes, a schematic and results for HepG2 transfection experiment. FIG. 59 shows Experimental schematic and results for hydrodynamic injection experiments. FIG. 60 shows the HBV life cycle within HepG2.2.15 cells and schematic of lentiviral vector and experimental strategy for sustained CRISPR expression within HepG2.2.15 cells. FIG. 61 shows that HBV-targeting CRISPR reduces HBV DNA and cccDNA dependent upon HBV-specific guide RNA and Cas9 activity. FIG. 62 shows HBV products are reduced upon long-term CRISPR/Cas expression. FIG. 63 shows that CRISPR constructs targeting HBV cause large and progressive reduction in cccDNA and total HBV DNA levels dependent on successful targeting of viral DNA. FIG. 64 shows HBV DNA and cccDNA reductions upon long-term CRISPR/Cas expression are produced with multiple guides. FIG. 65 shows Southern blot of HBV DNA. FIG. 66 shows Southern blot of HBV DNA. FIG. 67 shows Surveyor assay to detect indel formation in total HBV DNA and episomal HBV DNA. FIG. 68 demonstrates large reduction in HBV Core protein staining upon targeting by g17 specifically against the Core ORF as determined by immunofluorescence. FIG. 69 shows schematics for de novo infection experiments. FIG. 70 shows HBsAg secretion, cccDNA copies, levels of HBV 3.5 kb RNA relative to 5 bp mismatch control and titer of HBV DNA in culture medium in de novo infection context. FIG. 71 shows CRISPR/Cas-mediated disruption of HBV in patient-derived virus model system. FIG. 72 shows Surveyor assay results.

Construction of CRISPR Constructs. Cas9 constructs with 24 guide RNAs targeting sequences present in the HBV genome integrated into the HepG2.2.15 cell line were used for thes experiments (Sells et. al., PNAS 1987). Oligos corresponding to target sequences were ligated into BbsI (ThermoScientific #FD1014) digested plasmid PX330a or BsmBI (ThermoScientific #FD0454) digested plasmid PHBC013 using T7 ligase (Enzymatics L6020L) (Hsu et. al., "DNA targeting specificity of RNA-guided Cas9 nucleases," Nature Biotechnology 31,827-832(2013) (Hsu et al Nat Biotechnol 2013)). PX330a contains a U6 promoter driving expression of the +85 guide RNA described in Hsu et. al. (Nat Biotechnol 2013) and a mammalian codon optimized NLS-Cas9-NLS from *S. pyogenes* SF370 driven by the CBh promoter. PHBC013 contains the U6 guide RNA expression system from PX330a and NLS-Cas9-P2A-mCherry driven by the EFS promoter. PHBC013 was created from pHKO_015 by digesting pHKO_015 with NheI (Thermo- Scientific #FD0974) and MluI (ThermoScientific #FD0564) and then inserting mCherry using Gibson Assembly with the Gibson Assembly Master Mix (NEB, #E261 IL). The red fluorescent mCherry marker makes it easy to see which cells have been transfected with the vector. See FIG. 57B for an illustration of the constructs. Two sets of control constructs were generated. Mismatched guide RNA control constructs for promising guide RNA molecules were created by ligating in oligos to PX330a or PHBC013 that contained 5 basepair mismatches at the 3' end of the spacer, but were otherwise identical to constructs designed to target HBV. Cas9 D10A/H840A nuclease dead control constructs were generated by digesting pHBC013 guide RNA containing constructs with BamHI and NheI and then inserting a PCR amplified D10A/H840A Cas9 using Gibson Assembly. D10A and H840A are mutations that are sufficient to abolish the nuclease activity of S. pyogenes SF370 Cas9 (Cong et. al. "Multiplex genome engineering using CRISPR/Cas systems," Science 339, 819-823, Sapranauskas et. al. "The Streptococcus thermophilus CRISPR/Cas system provides immunity in Escherichia coli," Nucleic Acids Res Nov 2011; 39(21): 9275-9282.). The control vectors still express the sgRNA.

Guide RNAs: Available genome sequences reveal that various genomic regions are well conserved across multiple strains. Numbered according to the ayw serotype the following genomic regions are well conserved:

TABLE 30

| Nucleotides | Genomic region |
| --- | --- |
| 153-286 | S |
| 376-401 | S |
| 1113-1319 | Pol, Enh I |
| 1393-1462 | Pol, X |
| 1860-1979 | Precore/Core, Poly A signal |
| 2356-2457 | Core, Pol |

24 guide RNAs have been designed to target the HBV genome (FIGS. 36, 57). These include targets which are highly conserved within the HBV genome. Moreover, guide sequences can be designed to minimize possible off-target sites within the human genome e.g. to include at least 2 mismatches relative to any other sequence in the published human genome sequence. For instance, the closest matches in the human genome for guide G6 differs by at least 3 nucleotides (2 hits) or 4 nucleotides (43 hits).

Furthermore, the HBV genome includes 162 NGG PAMs within genome (41 of which are in conserved tracts) and 160 NAG PAMs (32 in conserved tracts).

In addition, the target sequences can be assessed against available complete HBV genome sequences deposited in GENBANK (5052 complete sequenced genomes) to check coverage against patient-derived virus isolates. For instance, 91.2% of these sequences have a perfect match for guide G6, and 87.3% have a perfect match for guide G21.

Guide RNAs were of the form 5'-G(N19)-3' (wherein N is any of AUC or G) with their target sequences having the form of 5'-G(N19)-NGG-3' (wherein N is any of ATC or G). Guides 1-12 were designed to target all 4 ORFs and guides 13-24 were designed against HBV sequences that were conserved across HBV genotypes (See, e.g., U.S. Pat. No. 8,350,021). See also FIGS. 36, 57. Thus, for guides 1-12, the target motif 5'-G(N19)-NGG-3' appears in all of the 4 ORFs of HBV, and hence the guide RNA binds accordingly to said motifs. Likewise, for guides 13-24, the target motifs 5'-G (N19)-NGG-3' are conserved across HBV genotypes and guide RNA binds accordingly. Advantageous guides, G6, G17, and G21 have the following sequences:

```
Guide 6
                                  SEQ ID NO: 1565
5'-ggggcgcacctctctttacg-3'

Guide 17
                                  SEQ ID NO: 1566
5'-taaagaatttggagctactg-3'

Guide 21
                                  SEQ ID NO: 1567
5'-tcctctgccgatccatactg-3'
```

The putative mechanism of action for the CRISPR complexes is on the cccDNA which is produced during HBV infection and can remain latent in the nucleus for years. It is postulated that cccDNA is cleaved by Cas9 after hybridization to the designed guide RNAs. Thus, FIG. 37 illustrates a means for determining cccDNA of HBV.

Experiments to test the guide RNAs, as described below, used either HepG2 cells which were artificially infected with HBV, or HepG2 2.15 cells which have an overlength linear double stranded HBV DNA segment integrated into their genome and constitutively produce HBV transcripts, infectious virions and cccDNA.

Cells and Reagents. HepG2 2.15 cells were maintained in DMEM+10% Fetal Bovine Serum/1× Penicillin/Streptomycin (maintenance medium) for long-term culture, and passaged every 5-7 days. See also Cohen et al, 2010. All cells used were between passage 4 and passage 8. Up to 1 week prior to treatment, HepG2 2.15 cells were treated with 2% DMSO in order to promote growth arrest for accurate cell quantification, and to promote hepatic differentiation and increase HBV replication and cccDNA formation.

Transient transfection Experiments HepG2 2.15 cells: HepG2 cells were plated at ~30% confluency and grown until 50% confluency, and then were co-transfected with the plasmid shown in FIG. 57B (lentiviral backbone with an mCherry reporter), and a 1.3× length WT HBV plasmid was used as previously described (Doitsh, G. et al. 2004), using the Mirus Trans-IT transfection reagent. Cells were washed and fed after 24 hours, and supernatant and cell pellets were assayed at 72 hours post transfection.

Transfection Experiments HepG2 2.15 cells. HepG2 2.15 cells were plated on standard tissue-culture plastic that had been coated with 50 μg/mL Collagen I (Rat tail collagen I, BD) at a confluency of 40-80%. 24 hours post seeding, transfection polyplexes were formed by incubating selected CRISPR-Cas or control plasmid DNA at a 1:3 ratio with TransIT 2020 (Mirus) transfection reagent in Opti-MEM reduced serum media for 30 minutes. HepG2 2.15 cells were washed, and transfection mixture was added to the cells at a dose of 250 ng DNA/1 cm$^2$ growth area. Transfection was carried out for 48 hours, and then cells were washed 3 times in maintenance medium and cultured for an additional 24 hours. Finally, cells were harvested and prepared for fluorescence activated cell sorting (FACS) by standard protocols, with the addition of Sytox Blue dye to label dead cells. Cells were analyzed by FACS and a given number of and single, living cells were collected from each condition in each of two groups: mCherry+ (successfully transfected) and mCherry− (unsuccessfully transfected) (FIG. 41). These cells were harvested either into lysis buffer (for DNA quantification) or Trizol reagent (for RNA quantification) and the resulting material was analyzed by Applicants' standard assays.

Lentivirus production: 293T cells were co-transfected with the sgRNA-Cas9-2A-Puro lentiviral vectors (FIG. 60B) and a 2nd-generation lentiviral packaging system (psPAX2 and pMD2.G) at a ratio of 3:2:1. Cells were washed 24 h after transfection, supernatant was collected every 24 h from 48-96 h post transfection, and cell debris was removed by centrifugation. Lentivirus was concentrated by ultracentifugation for 1.5 h at 16,600× g, incubated O/N in Optimem at 4C, then resuspended in Optimem, aliquoted and frozen at −80C the next day, prior to use.

Lentiviral transduction: HepG2 2.15 cells were plated at 50% confluency and inoculated at MOI of 1 with concentrated lentivirus (produced as described above). Transduction was performed by mixing lentivirus aliquots with standard HepG2.2.15 culture medium, washing cells and adding lentivirus-containing medium at 2.5 mL/well in a 6-well plate, centrifuging for 1 h at 200× g and then incubating for an additional 23 h. 24 h after addition of lentivirus, cells were washed 3× and incubated in standard medium+2.5 ug/mL puromycin to remove untransduced cells. Puromycin selection was continued for 48 h, then cells were washed 3× and maintained in standard medium. Transduced cells were then continually passaged upon reaching 80% confluence; at each passage, cells were counted, cell pellets were harvested for each condition, and a portion of the remaining cells were reseeded at 10% confluence. Cells with lentiviral constructs looked phenotypically normal and exhibited no growth defects over at least 10 weeks in culture.

In vitro Cotransfection Experiments: HepG2 cells were seeded at 60-70% confluence on collagen pre-coated plates. 24 h after seeding cells were transfected with 1.3×HBV together with the corresponding CRISPR encoding constructs using Trans-IT 2020 (MIRUS) transfection reagent at a ratio of 1:4, respectively. 48-72 after transfection medium was collected and analyzed for HBsAg using a commercial ELISA kit (Bio-Rad). Cells were collected at the same time, RNA was extracted with TRIZOL and cDNA was synthesized using SuperScript (Invitrogen) kit. Q PCR was done using specific primers for HBV pgRNA. Normalization was done to human RPS11 housekeeping gene.

In vivo Hydrodynamic Co-Injection Experiments. NRG mice were hydro dynamically injected (HDD) as previously described (Lewis, D. L. et al., 2005) with 1.3×HBV plasmid (15 ug) together with CRIPSR encoding (20 ug) and firefly luciferase (10 ug) encoding plasmids (pSPORT6-Fluc) in a volume equal to 0.15 times the animal weight (in mls). Animals were injected through the tail vein in 7-9 sec and subsequentially bled every few days. At the time of bleeding animals were visualized using the IVIS machine and luciferase expression was quantified. Blood was analyzed for HBsAg using a commercial ELISA kit and for serum HBV DNA (viremia) by Q-PCR using TaqMan mastermix with HBV specific primers and probe. Quantification was done according to a standard curve with known concentrations of 2×HBV plasmid. HBsAg and DNA levels were normalized to luciferase expression at the corresponding day. 4 or 9 days after HDD animals were sacrificed, livers were collected and DNA was extracted following homogenization. The resulting DNA was subjected to QPCR for the following: total HBV DNA, cccDNA (following treatment of DNA with plasmid safe DNase and using cccDNA specific primers), GAPDH and luciferase.

Effect on pgRNA and cccDNA. The designed guide RNAs were studied for their effect on HBV pre-genomic mRNA (pgRNA) and on covalent-closed circular DNA (cccDNA), both of which are essential parts of the HBV life cycle.

Detection of secreted Hepatitis B Surface antigen in media supernatant: 100 ul of medium was loaded on ELISA plates coated with mouse monoclonal anti HBsAg antibodies (Bio-Rad, GS HBsAg EIA 3.0, Cat. No. 32591). ELISA protocol was done according to the manufacturer's instructions. Plates were read using the FLUOstar Omega machine (BMG LABTECH).

Hepatitis B e Antigen ELISA: The HBV E Antigen ELISA was performed using the Hepatitis B e Antigen (HBeAg) chemiluminescence Immunoassay kit (Autobio Diagnostics Co, Cat No.CL0312-2) according to the manufacturer's instructions.

Immunostaining for HBV Core antigen: Cells were grown on chambered coverglasses (Lab-Tek, Rochester, NY), washed with PBS, and then fixed with 4% paraformaldehyde. Cells were washed again (3× PBS) and treated with 100 mM glycine solution in PBS. After permeabilization with 0.1% Triton X-100 in PBS and treated with Image-iT™ FX signal enhancer (Life Technologies). Cells were blocked in PBS/10% goat serum (Jackson Immunosearch)/1% BSA. HBV core staining was achieved by using a polyclonal rabbit anti-HBV core antibody (Dako, CA) diluted 1:1000 in PBS/0.1% BSA (18 h at 4° C.). As a secondary antibody a goat-anti-rabbit labeled with AlexaFluor594 (Life Technologies) diluted 1:2000 in PBS/0.1% BSA was used. Nuclear staining was achieved using DAPI treatment. Image acquisition was performed in a Zeiss confocal microscope and image analysis was done using ImageJ (NIH, Bethesda, MD).

HBVDNA quantification: HBV genomic DNA was quantified at days 21 and 36. For cccDNA quantification DNA from cells was subjected to overnight digestion with a plasmid-safe DNase (Epicentre) as previously described (Yan H et al, "Sodium taurocholate cotransporting polypeptide is a functional receptor for human hepatitis B and D virus, eLife 2012 Nov. 13;1:e00049. doi: 10.7554/eLife.00049 (2012)). Following enzyme inactivation at 70° C. for 30 min, DNA was subjected to real-time PCR using cccDNA specific primers previously described by Glebe et al., "Pre-s1 antigen-dependent infection of Tupaia hepatocyte cultures with human hepatitis B virus,". J Virol. 2003; 77(17):9511-9521. The primers used for cccDNA amplification: 5'TGCACTTCGCTTCACCT3' (SEQ ID NO: 1568) (sense) 5' AGGGGCATTTGGTGGTC3' (SEQ ID NO: 1569) (anti sense). For quantification, a standard curve derived from decreasing concentrations of 2×HBV plasmid was used. Also, PCR for HBV DNA was done using the TaqMan® Universal PCR Master Mix (Applied Bio systems, Cat No 4304437) and the following primers and probe: 5'CCGTCTGTGCCTTCTCATCTG3' (SEQ ID NO: 1570) (sense), 5'AGTCCAAGAGTCCTCTTATGTAAGACCTT3' (SEQ ID NO: 1571) (anti sense), 5-/56-FAM/CCG TGT GCA/ZEN/CTT CGCTTC ACCTCT GC/3IABkFQ/-3 (SEQ ID NO: 1572) (probe). PCR was done using the Roche LightCycler®480 PCR machine. Quantification was done by using a standard curve composed from 2×HBV plasmid in a concentration range of 109-10$^1$ copies.

cccDNA extraction and analysis. DNA extracted from cells was subjected to ON digestion with a plasmid-safe DNase (Epicentre) as previously described (Yan H. et al., 2012). Following enzyme inactivation at 70° C. for 30 min, DNA was subjected to real-time PCR using SYBR® Premix Ex Taq (TaKaRa) following a previously described protocol (Yan H. et al., 2012) and using cccDNA specific primers previously described by Glebe et al., (2012). The primers used for cccDNA amplification:

```
(sense)
                              (SEQ ID NO: 1568)
5'TGCACTTCGCTTCACCT3'

(anti sense)
                              (SEQ ID NO: 1569)
5'AGGGGCATTTGGTGGTC3'.
```

For quantification, a standard curve derived from decreasing concentrations of 2×HBV plasmid was used. PCR was performed using the Roche LightCycler®480 PCR machine.

HBV mRNA quantification: Total RNA was isolated via TRIZOL RNA/DNA extraction. After being subjected to DNaseI treatment, RNA was quantified using a NanoDrop and first-strand cDNA was synthesized using SuperScript® III RT kit (INVITROGEN). Quantitative PCR for 3.5 kbRNA or total HBV RNA was carried out with SYBR Green PCR master Mix (Applied Biosystems) and using specific primers previously described (Yan H. et al., 2012). In each reaction an RT negative control was included to rule-out DNA carry over.

Southern blot analysis of HBV replication intermediates: Total DNA or Hirt's extract (low MW DNA) at day 29 was run on 0.8% agarose-TAE gel, followed by denaturation and southern blotting to a Hybond N nylon membrane (Amersham). Viral DNA was detected by hybridization with a $^{32}$P random primed HBV probe, using the Prime-It II Random Primer Labeling Kit (Agilent Technologies, Cat No 300385). Following incubation and washing, membrane was visualized by phosphorImager and later exposed to film.

Surveyor assay: Targeted loci were amplified by PCR using Phusion Flash (NEB) or Heruclase II (Agilent) polymerases and primers listed below. PCR products were gel or PCR-purified using Qiagen kits and subject to the Surveyor assay (Transgenomics) according to the manufacturer's instructions. Indel rate for surveyor was calculated as described in Cong, L. et al. (2013).

```
Surveyor Primers:
Guide6-F:
                              (SEQ ID NO: 1573)
TATCCATGGCTGCTAGGCTG Guide6-R:
                              (SEQ ID NO: 1574)
AGTCAGAAGGCAAAAACGAGAG Guide17-F1:
                              (SEQ ID NO: 1573)
TATCCATGGCTGCTAGGCTG Guide17-R1:
                              (SEQ ID NO: 1569)
AGGGGCATTTGGTGGTC Guide17-F2:
                              (SEQ ID NO: 1575)
AAATTGGTCTGCGCACCAGC Guide17-R2:
                              (SEQ ID NO: 1576)
AGGTCTCTAGATGCTGGATCTTCC Guide21-F1:
                              (SEQ ID NO: 1577)
GGTTATCCTGCGTTAATGCCC
```

-continued

```
Guide21-R1:
                              (SEQ ID NO: 1578)
GTCCGCGTAAAGAGAGGTG Guide21-F2:
                              (SEQ ID NO: 1579)
TGAACCTTTACCCCGTTGCCC Guide21-R2:
                              (SEQ ID NO: 1580)
AGAGAGTCCCAAGCGACCCC
```

Figure 57A:
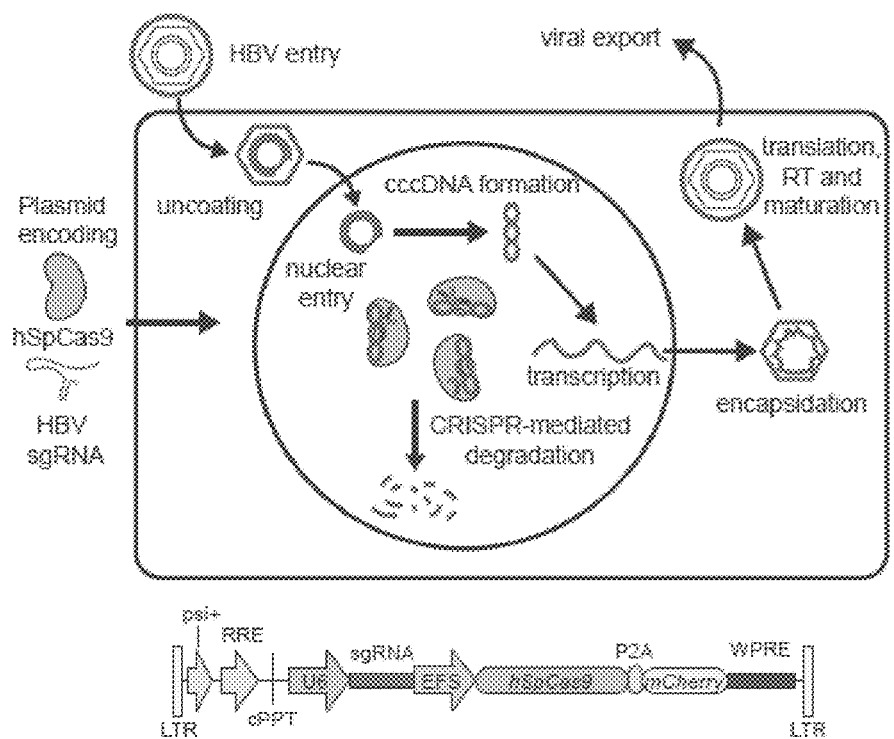
FIG. 57A-B shows (a) schematic of HBV life cycle and putative anti-HBV effect of CRISPR constructs; Cas9-mediated DSB formation should linearize the small, episomal cccDNA repeatedly, potentially leading to indel formation (generating less-fit viral mutants) or even degradation. (b) (left) HBV genome organization and location of target sequences for several tested guide RNA constructs, (right) Table of all possible CRISPR target sites in each HBV ORF, including number of possible target sites in conserved genomic regions.
Figure 57B:
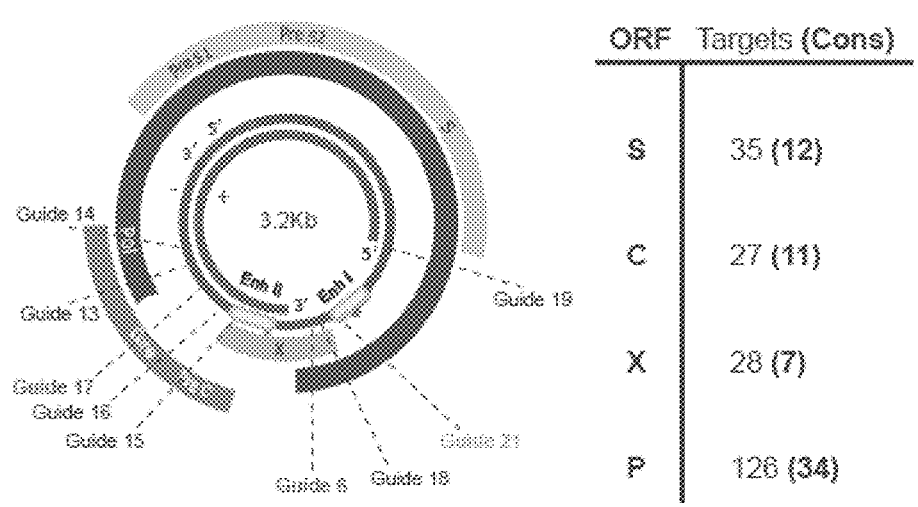

Concerning FIG. 57A, the diagram depicts the life cycle of HBV, showing where the Cas9/sgRNA targeting the virus putatively acts. cccDNA produced from HBV infection is cleaved by Cas9 after sgRNA binding to conserved HBV target site. FIG. 57A also illustrates the plasmid encodes both the HBV-targeting sgRNA and the Cas9 protein along with an mCherry fluorescent protein for subsequent fluorescent sorting of successfully transfected cells. Concerning FIG. 57B, targets were chosen based on regions of extremely high sequence conservation among different HBV serotypes and on their low homology to the human genome (see FIG. 58A). The guide RNAs target several different regions of the genome, hitting different ORFs and transcriptional control elements.

Figure 58A:
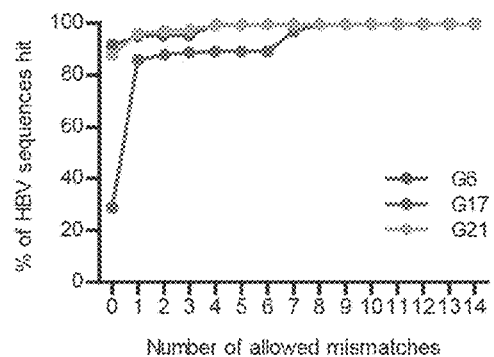
FIG. 58A-D shows (a) guide RNAs targeting conserved regions target large majority of patient-derived virus genomes. All whole-genome sequences from HBV isolates were queried from GenBank to determine the conservation of 23 nt target sequence (20 nt spacer +3 nt PAM) for 3 guides (6, 17, and 21). x-axis denotes number of allowed mismatches, and y-axis denotes the percentage of sequenced isolates that fall within this number of mismatches to native sgRNA target site; (b) schematic for HepG2 transfection experiments and (c-d): HepG2 cells co-transfected with 1.3× WT HBV and sgRNA/Cas9-2A-mCherry construct showing effect on HBsAg (c) and HBV 3.5 kb RNA (d).
Figure 58B:
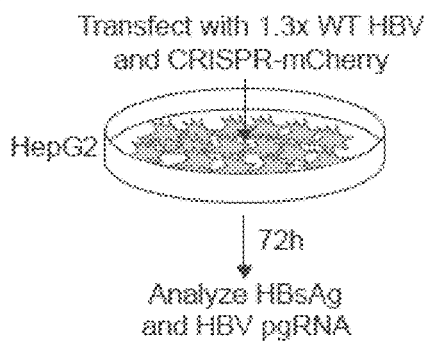
Figure 58C:
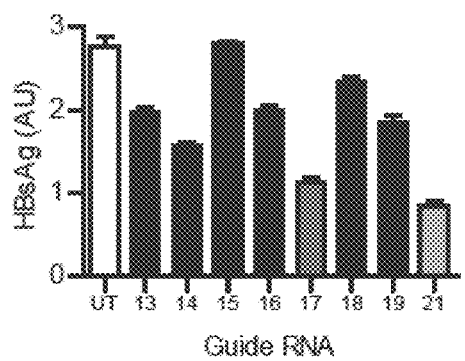
Figure 58D:
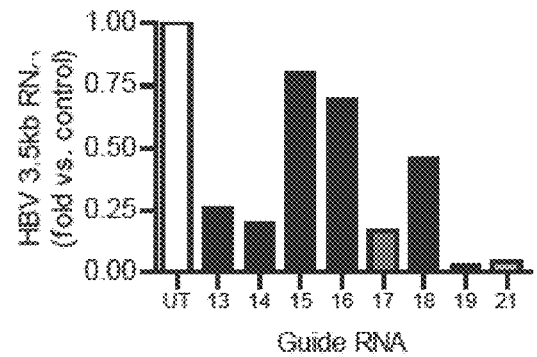

HepG2 cells were co-transfected with 1.3× WT HBV and Cas9/sgRNA/mCherry plasmids and HBV replication was allowed to proceed for 72 hours (see schematic depicted at FIG. 58B). Then, supernatants were collected and cells lysed for RNA extraction. (FIG. 58C) ELISA for secreted HBsAg with either control guide RNA (untargeted guide RNA) or various HBV-targeting guide RNAs. (FIG. 58D) Fold change in 3.5 kb HBV pregenomic RNA (pgRNA) levels between untargeted and HBV-targeting guide RNAs. The Figures show levels of HBsAg quantified using ELISA, and guides 17 and 21 showed the best reductions. The Figures also show levels of pgRNA and, while these were lower using all of guides 13-21, the most impressive results were again seen with 17 and 21. Based on the results of these two assays, along with earlier preliminary data showing the strong cutting behavior of guide 6, the guides 6, 17, and 21 were chosen for further study.

Figure 59A:
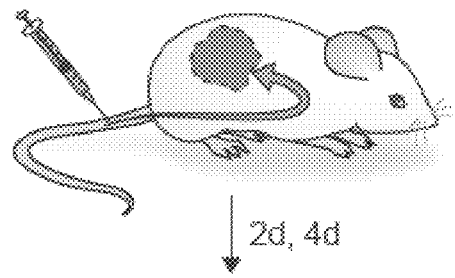
FIG. 59A-C shows (a) Experimental schematic for hydrodynamic injection experiments of (b-c): 1.3× WT HBV and sgRNA/Cas9-2A-mCherry are delivered to the livers of immunodeficient NRG mice via hydrodynamic injection, and (b) HBsAg and (c) secreted HBV titer are quantified in mouse blood at 2 and 4 days post injection. 21M: guide RNA with 5 bp mismatch from g21. Data shown are from one representative experiment, and consistent across multiple experiments. UT: 'untargeted' guide RNA (no target sequence in HBV genome). *p<0.05 for selected comparison; p<0.01 for selected comparison; *p<0.001 for selected comparison as assessed by two-tailed t-test.
Figure 59B:
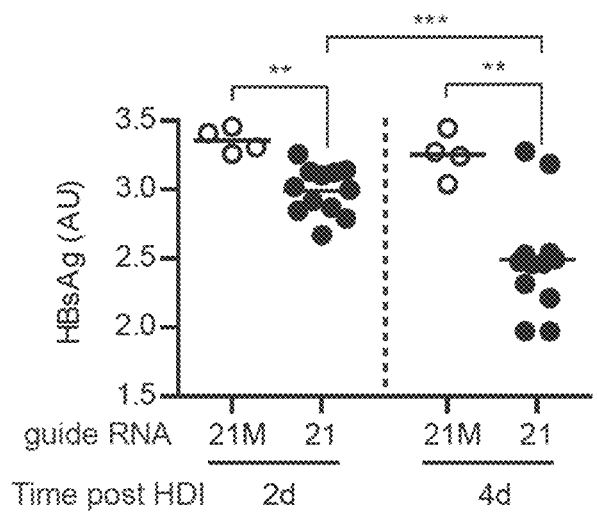
Figure 59C:
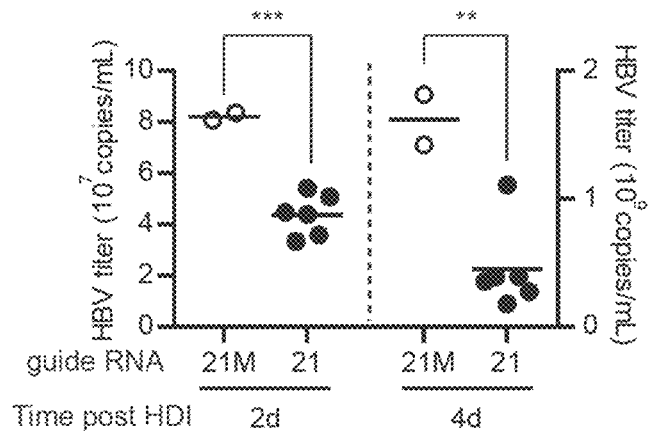

Applicants next sought to evaluate the antiviral effect of Cas9 in vivo, to ensure that anti-HBV constructs functioned appropriately in primary hepatocytes. To do this, a mouse model of HBV was used, where HBV and Cas9/gRNA plasmids were introduced to the liver of immunodeficient mice (NRG) by hydrodynamic injection (HDI) (Lewis, D. L. et al., 2005) (FIG. 59A). Animals expressing Cas9 and g21 in this model showed a progressive suppression of HBV expression as compared to controls expressing Cas9 and a mutated gRNA (g21M; 3' 5 bp mismatch), reflected by a decrease in HBsAg secretion and a 4-fold decrease in viremia at day 4 post injection (FIGS. 59B and 59C).

Applicants evaluated the efficacy of sustained Cas9/gRNA expression in inhibiting HBV using a model that more reliably recapitulates the HBV life cycle. For these studies, the HepG2.2.15 hepatoblastoma cell line was used which harbors both a functional HBV integrated form and cccDNA, and constitutively produces infectious virions (see FIG. 60A). FIG. 60 shows (a) the HBV life cycle within HepG2.2.15 cells. HepG2.2.15 cells contain genomically integrated linear 1.3× WT HBV sequences, from which viral proteins and cccDNA are constitutively produced via transcription followed by translation (proteins) or reverse transcription and nuclear re-import (cccDNA). The persistent HBV production in this system enables assay of the long-term anti-HBV effects of CRISPR/Cas systems targeting viral DNA; and (b) schematic of lentiviral vector and experimental strategy for sustained CRISPR expression within HepG2.2.15 cells. Concentrated lentiviral stocks encoding HBV-targeting sgRNA, Cas9, and a puromycin resistance element to allow for lentiviral transduction and subsequent selection of stable lines incorporating Cas9 and each guide RNA were produced. HepG2 2.15 cells were transduced with concentrated lentivirus encoding Cas9-2A-Puro or nuclease deficient (D10A/H840A "dead") Cas9-2A-Puro and either guide 6, 17, or 21, or one of three different untargeted sequences, followed by puromycin selection to yield HepG2 2.15 lines stably expressing the CRISPR/Cas system. FIG. 61 shows that Guide 6, 17, and 21 drastically decreased total HBV DNA and cccDNA in a manner dependent on correct targeting to HBV, and on Cas9 nuclease activity. Comparing the results from 29 and 36 days post transduction, Applicants see that the levels of HBV DNA and cccDNA continue to decrease over time, consistent with results from lentiviral transduction of CRISPR/Cas in other cell systems. The Figures also show that the 'dead' Cas9 had little impact on the amount of HBV genomic DNA at day 21 or 36 (about 50 copies per cell), but that guides 6, 17 and 21 in combination with active Cas9 reduced DNA to fewer than 10 copies per cell at day 21, and even fewer copies at day 36. Thus the Cas9 system drastically decreased total HBV DNA and cccDNA in a manner dependent on correct targeting to HBV, and on Cas9 nuclease activity. Moreover, a similar effect was seen on cccDNA, which was almost undetectable using guide 21 (much less than 1 copy per cell on average) at day 36.

In separate control experiments, cells were also transduced with constructs containing gRNAs and a nuclease deficient Cas9 (D10A/H840A; dead Cas9) to control for nuclease-independent effects of Cas9 on viral fitness, or WT Cas9 with mutated gRNAs (gXM) to control for guide sequence-independent effects. Cas9/gRNAs induced robust suppression of HBV DNA release (77-95% decrease across different gRNAs), HBeAg secretion, and viral mRNA production (greater than 50%) (FIG. 62). MORE Applicants next analyzed the effect of Cas9-mediated cleavage on the abundance of non-integrated viral forms, composed mainly of cccDNA. qPCR showed a robust reduction in total HBV DNA and in cccDNA, with the latter progressing from 71+/−7% reduction at day 21 to 92+/−4% at day 36 post transduction (FIGS. 63 and 64).

These results were confirmed by directly analyzing low molecular weight DNA from transduced cells by Southern blot (FIG. 65). cccDNA and its deproteinated relaxed circular form (dpRC DNA) precursor were greatly depleted in Cas9/gRNA transduced cells. In contrast, when total HBV DNA was analyzed, no substantial reduction in the levels of integrated HBV DNA was detected (FIG. 66). The Southern blot of HBV DNA at 29 days post transduction of FIG. 65 is the results of a Southern blot that was performed on the DNA harvested from the HepG2 2.15 cell lines at 29 dpt, either using standard DNA extraction for total DNA, or using a modified Hirt's extraction to specifically enrich for low molecular weight, non-chromosomal DNA. For Hirt's extraction, both total DNA and mtDNA are shown as loading controls since mtDNA should persist through the extraction procedure. Note the almost complete absence of HBV DNA in the on-target, nuclease-competent lanes. FIG. 65 shows that, with either high or low exposure, the rcDNA, cccDNA and ssDNA forms of HBV are essentially undetectable using guide 6 or 21, and (except for rcDNA) are barely detectable using 17. Then at day 36 linear dsDNA, cccDNA and ssDNA are essentially undetectable using 17 and 21, whereas levels of integrated HBV DNA remain unaffected (since Cas9-mediated cleavage of integrated DNA should result in NHEJ-mediated DNA repair and maintenance of the integrated HBV DNA although potentially in mutated form). This degree of reduction in HBV cccDNA (even in a cell line system) compares very favorably to the available literature on cccDNA-targeting HBV therapeutics.

The Southern blot of HBV DNA at 36 days post transduction of FIG. 66 is the results of a Southern blot was performed at 36 days post transduction, and specifically looks at differential effects on integrated HBV DNA vs. intermediate HBV forms and cccDNA. Note that on-target, nuclease-competent guides drastically reduce the levels of linear dsDNA, cccDNA, and ssDNA while levels of integrated HBV DNA remain unaffected (since Cas9-mediated cleavage of integrated DNA should result in NHEJ-mediated DNA repair and maintenance of the integrated HBV DNA, although potentially in mutated form). This degree of reduction in HBV cccDNA demonstrates that the CRISPR-Cas system can be a cccDNA-targeting HBV therapeutic.

Surveyor assay was performed on DNA extracts from CRISPR-transduced HepG2 2.15 cells to directly determine whether the viral DNA was cleaved and repaired via error-prone NHEJ similar to genomic targets of CRISPR/Cas9 and the results thereof are illustrated in FIG. 67. The Surveyor T7E1 endonuclease assay was performed to assess indel formation in HBV DNA in this system. Analysis of total HBV DNA forms for indel formation, an indirect measure of Cas9-mediated cleavage, revealed high levels of cutting (FIG. 67, top panel). Lower levels were seen in cccDNA that was amplified from the cells after DNAse treatment to destroy non-circular integrated HBV DNA (0% vs 32%, 62% vs 88% and 21% vs 66% for guides 21, 17 and 6, respectively) (FIG. 67, bottom panel).

Consistent with high levels of indel formation in the core ORF targeted by g17, immunostaining for HBV core protein (HBc) revealed a robust reduction in HBc levels in g17-expressing cells as compared to controls (FIG. 68).

To evaluate Cas9 treatment in a setting of de novo infection, Applicants used HepG2 cells overexpressing the HBV receptor NTCP (Hep-NTCP) (Yan H. et al. 2012), which are permissive to infection with HBV. Because g17 showed the highest levels of indel formation in cccDNA in the HepG2.2.15 experiments, these cells were transduced with Cas9/g17, Cas9/g17M, or dead Cas9/g17 lentiviruses, co-cultured with HBV producing HepG2.2.15 cells, and selected with puromycin to eliminate non-transduced Hep-NTCP and contaminating HepG2.2.15 cells (FIG. 69, left). Alternatively, Hep-NTCP cells were selected with puromycin following transduction and subsequently infected with HBV-positive patient serum (FIG. 69, right). When the transduced Hep-NTCP were infected with cell culture-produced virus, Cas9/g17 greatly abrogated productive HBV infection, as reflected by reduction in HBsAg and HBV DNA secretion, as well as 3.5 kbRNA and cccDNA levels, compared to controls (FIG. 70); this finding was confirmed following infection with patient-derived virus (FIG. 71). Surveyor assay performed using DNA from cells infected de novo with HepG2.2.15-derived virus confirmed direct cleavage of HBV episomal DNA (FIG. 72). Although minor cleavage was also detected in the mutated g17M, this most likely was due to low-level cleavage with DNA bulge-containing guide RNAs (Lin Y. et al. 2014). This finding provides direct evidence that Cas9 is capable of targeting episomal forms of the virus, and exerting anti-HBV effects by directly targeting cccDNA.

These experiments show that clearance of HBV cccDNA can be mediated by the expression of CRISPR-Cas constructs in cells either constitutively expressing or de novo transfected with HBV DNA. Given the high percentage of cccDNA+ hepatocytes in chronically HBV infected livers, it would be suitable to package the CRISPR-Cas system encompassing optimal HBV target sequences into a highly efficient, liver-specific vector such as adeno-associated virus, subtype 8 (AAV8) (Sands M S, "AAV-mediated liver-directed gene therapy," Methods Mol Biol. 2011; 807: 141-57. doi: 10.1007/978-1-61779-370-7_6). Additionally, to enforce the specificity or targeting and improve in vivo Cas9 expression, it will be desirable to include hepatocyte-specific transcriptional control regions (Miao C H et al, "Inclusion of the hepatic locus control region, an intron, and untranslated region increases and stabilizes hepatic factor IX gene expression in vivo but not in vitro," Mol Ther 2000 Jun;1(6):522-32). The dosing regimens would be optimized for both in vivo expression and prevention of an anti-AAV immune response, using information taken from the 100+ clinical trials that have been undertaken using AAV vectors (www.abedia.com/wiley/vectors.php). While incorporation of anti-HBV CRISPR-Cas systems into AAV vectors is still ongoing, the recent gene therapeutic success of other vector types, such as γ-retroviruses (Aiuti A et al, "Leinviral Hematopoietic Stem Cell Gene Therapy in Patients with Wiskott-Aldrich Syndrome," Science 341 no. 6148, 2013; Biffi A et al, "Lentiviral Hematopoietic Stem Cell Gene Therapy Benefits Metachromatic Leukodystrophy," Science Vol. 341 no. 6148, 2013) opens up even more vector possibilities for human dosing, and provides a heightened level of comfort with using CRISPR-based gene therapy to excise HBV from infected hepatocytes.

Moreover, these experiments show that the CRISPR-Cas system can be used therapeutically to target and reduce the presence of HBV, especially cccDNA of HBV.

De novo HBV infection of in patient-derived hepatocytes (either primary human hepatocytes or iPS-derived hepatocytes) using the CRISPR-Cas system and constructs as herein described and illustrated obtain similar therapeutically significant results, especially because infection in these systems is performed with patient plasma-derived virus.

Cas9 cleavage of HBV cccDNA generates γ-H2AX and Cas9 cleavage of HBV cccDNA linearizes the cccDNA which may be left unrepaired and potentially degraded after being linearized by Cas9.

Yan et al, eLife (2012) identified a specific 2-48aa sequence in the PreS1 protein of HBV responsible for binding to the sodium taurocholate cotransporting polypeptide (NTCP), the recently discovered receptor for HBV. Targeting sgRNAs against this region may induce indel formation and mutation of this region may result in the production of virions incapable of binding and entering new hepatocytes, leading to another mechanism of viral clearance even if all cccDNA cannot be eliminated.

Moreover, the results herein invite co-administration of CRISPR/Cas system and epigenetic modifier drugs: The HBV cccDNA 'minichromosome" is a very densely-packed, nucleosome-associated structure with HBV DNA tightly coiled around histone proteins and HBV Core protein (HBc), leading to nucleosomal spacing even shorter than standard chromosomal spacing. HBV transcription are regulated by epigenetic marks on associated histones, which lead to the recruitment of several host cellular transcription factors, and epigenetic modification of cccDNA minichromosomes has shown some promise in reducing the transcription of HBV RNAs and also in leading to cccDNA degradation (for example, IFN-alpha's cccDNA degrading ability may be related to induction of epigenetic changes on the cccDNA). Since Cas9 targeting to cccDNA is likely at least partially dependent on the cccDNA structure, co-treatment with epigenetic modifiers (for example Class I and Class III HDAC inhibitors trichostatin A (TSA), valproate, and nicotinamide (NAM), and Type I interferons) may be a valuable strategy for increasing Cas9 occupancy on HBV cccDNA. The invention comprehends administration of the CRISPR-Cas system with such epigenetic modifier drugs; or other drugs presently used to treat HBV. The skilled person can use doses and formulations of such drugs presently used, in combination with the CRISPR-Cas system in doses and formulations as herein described to treat HBV.

Example 29: Other Viruses

Other viruses can also be targeted using the same approach, and in particular DNA viruses (typically dsDNA viruses). For example, herpes simplex virus (HSV), human papillomavirus (HPV), Epstein Barr virus (EBV), varicella zoster virus (VZV), and any other virus which integrates into a host mammal's genome and/or has a latent circular episomsal form. CRISPR systems of the invention can be targeted to cell types which maintain the latent virus e.g. B cells or epithelial cells for EBV, neurons for HSV and VZV, epithelial cells for HPV, etc.

HSV1/2 forms stable latent infection phase in neurons in episomal form, and the latent DNA is (similar to HBV) complexed with nucleosomes and other transcription-regulating machinery. There are AAV subtypes (AAV2) which efficiently target neurons, and this is a good target. HPV has a low copy-number, episomal DNA form in basal keratinocytes, activation of replication as differentiation occurs into the squamous layer; targeting these cells is relatively easy since mucosal sites are accessible, and if done early after detection, viral dissemination could be halted by using a CRISPR-Cas system as herein discussed. Plant viruses are also suitable targets. Accordingly, the herein studies as to HBV are readily extendable to other mammalian or human viruses and plant viruses.

REFERENCES

Banker G, Goslin K. Developments in neuronal cell culture. Nature. 1988 Nov. 10; 336(6195):185-6.

Bedell, V. M. et al. In vivo genome editing using a high-efficiency TALEN system. Nature 491, 114-U133 (2012).

Bhaya, D., Davison, M. & Barrangou, R. CRISPR-Cas systems in bacteria and archaea: versatile small RNAs for adaptive defense and regulation. Annu Rev Genet 45, 273-297 (2011).

Bobis-Wozowicz, S., Osiak, A., Rahman, S. H. & Cathomen, T. Targeted genome editing in pluripotent stem cells using zinc-finger nucleases. Methods 53, 339-346 (2011).

Boch, J. et al. Breaking the code of DNA binding specificity of TAL-type III effectors. Science 326, 1509-1512 (2009).

Bogenhagen, D. F. & Brown, D. D. Nucleotide sequences in Xenopus 5S DNA required for transcription termination. Cell 24, 261-270 (1981).

Bultmann, S. et al. Targeted transcriptional activation of silent oct4 pluripotency gene by combining designer TALEs and inhibition of epigenetic modifiers. Nucleic Acids Res 40, 5368-5377 (2012).

Carlson, D. F. et al. Efficient TALEN-mediated gene knockout in livestock. Proc Natl Acad Sci USA 109, 17382-17387 (2012).

Chen, F. Q. et al. High-frequency genome editing using ssDNA oligonucleotides with zinc-finger nucleases. Nat Methods 8, 753-U796 (2011).

Cho, S.W., Kim, S., Kim, J. M. & Kim, J. S. Targeted genome engineering in human cells with the Cas9 RNA-guided endonuclease. Nat Biotechnol 31, 230-232 (2013).

Christian, M. et al. Targeting DNA double-strand breaks with TAL effector nucleases. Genetics 186, 757-761 (2010).

Cohen, D et al., Hepatitis B virus activates deoxynucleotide synthesis in nondividing hepatocytes by targeting the R2 gene. Hepatology 51, 1538-1546 (2010).

Cong, L. et al. Multiplex genome engineering using CRISPR-Cas systems. Science 339, 819-823 (2013).

Deltcheva, E. et al. CRISPR RNA maturation by trans-encoded small RNA and host factor RNase III. Nature 471, 602-607 (2011).

Deveau, H., Garneau, J. E. & Moineau, S. CRISPR-Cas system and its role in phage-bacteria interactions. Annu Rev Microbiol 64, 475-493 (2010).

Ding, Q. et al. A TALEN genome-editing system for generating human stem cell-based disease models. Cell Stem Cell 12, 238-251 (2013).

Garneau, J. E. et al. The CRISPR-Cas bacterial immune system cleaves bacteriophage and plasmid DNA. Nature 468, 67-71 (2010).

Gasiunas, G., Barrangou, R., Horvath, P. & Siksnys, V. Cas9-crRNA ribonucleoprotein complex mediates specific DNA cleavage for adaptive immunity in bacteria. Proc Natl Acad Sci USA 109, E2579-2586 (2012).

Geurts, A. M. et al. Knockout Rats via Embryo Microinjection of Zinc-Finger Nucleases. Science 325, 433-433 (2009).

Glebe D. et al., Pre-S1 Antigen-Dependent Infection of Tupaia Hepatocyte Cultures with Human Hepatitis B Virus. Journal of Virology 77, 9511-9521 (2003).

Gray S J, Foti S B, Schwartz J W, Bachaboina L, Taylor-Blake B, Coleman J, Ehlers M D, Zylka M J, McCown T J, Samulski R J. Optimizing promoters for recombinant adeno-associated virus-mediated gene expression in the peripheral and central nervous system using self-complementary vectors. Hum Gene Ther. 2011 September;22(9): 1143-53. doi: 10.1089/hum.2010.245.

Guschin, D. Y. et al. A rapid and general assay for monitoring endogenous gene modification. Methods Mol Biol 649, 247-256 (2010).

Hasty, P., Rivera-Perez, J. & Bradley, A. The length of homology required for gene targeting in embryonic stem cells. Mol Cell Biol 11, 5586-5591 (1991).

Horvath, P. & Barrangou, R. CRISPR-Cas, the immune system of bacteria and archaea. Science 327, 167-170 (2010).

Hsu, P. D. & Zhang, F. Dissecting neural function using targeted genome engineering technologies. ACS Chem Neurosci 3, 603-610 (2012).

Hwang, W. Y. et al. Efficient genome editing in zebrafish using a CRISPR-Cas system. Nat Biotechnol 31, 227-229 (2013).

Jiang, W., Bikard, D., Cox, D., Zhang, F. & Marraffini, L. A. RNA-guided editing of bacterial genomes using CRISPR-Cas systems. Nat Biotechnol 31, 233-239 (2013).

Jinek, M. et al. A programmable dual-RNA-guided DNA endonuclease in adaptive bacterial immunity. Science 337, 816-821 (2012).

Jinek, M. et al. RNA-programmed genome editing in human cells. eLife 2, e00471 (2013).

Kaplitt, M. G., et al., Safety and tolerability of gene therapy with an adeno-associated virus (AAV) borne GAD gene for Parkinson's disease: an open label, phase I trial. Lancet. 2007 Jun. 23; 369(9579):2097-105.

Levitt N. Briggs D. Gil A. Proudfoot N. J. Definition of an efficient synthetic poly(A) site. Genes Dev. 1989; 3:1019-1025.

Lewis, D. L. et al. Delivery of siRNA and siRNA expression constructs to adult mammals by hydrodynamic intravascular injection. Methods Enzymol. 392, 336-350 (2005).

Lin Y. et al. CRISPR/Cas9 systems have off-target activity with insertions or deletions between target DNA and guide RNA sequences. Nucleic Acids Research 42, 7473-7485 (2014).

Liu D, Fischer I. Two alternative promoters direct neuron-specific expression of the rat microtubule-associated protein 1B gene. J Neurosci. 1996 Aug. 15; 16(16):5026-36.

Lopes, V. S., etc al., Retinal gene therapy with a large MYO7A cDNA using adeno-assocaited virus. Gene Ther, 2013 Jan. 24. doi: 10 1038/gt 2013.3.[Epub ahead of print] Mahfouz, M. M. et al. De novo-engineered transcription activator-like effector (TALE) hybrid nuclease with novel DNA binding specificity creates double-strand breaks. Proc Natl Acad Sci U S A 108, 2623-2628 (2011).

Makarova, K. S. et al. Evolution and classification of the CRISPR-Cas systems. Nat Rev Microbiol 9, 467-477 (2011).

Mali, P. et al. RNA-guided human genome engineering via Cas9. Science 339, 823-826 (2013).

McClure C, Cole K L, Wulff P, Klugmann M, Murray A J. Production and titering of recombinant adeno-associated viral vectors. J Vis Exp. 2011 Nov. 27; (57):e3348. doi: 10.3791/3348.

Michaelis, L. M., Maud "Die kinetik der invertinwirkung.". Biochem. z (1913).

Miller, J. C. et al. An improved zinc-finger nuclease architecture for highly specific genome editing. Nat Biotechnol 25, 778-785 (2007).

Miller, J. C. et al. A TALE nuclease architecture for efficient genome editing. Nat Biotechnol 29, 143-148 (2011).

Moscou, M. J. & Bogdanove, A. J. A simple cipher governs DNA recognition by TAL effectors. Science 326, 1501 (2009).Porteus, M. H. & Baltimore, D. Chimeric nucleases stimulate gene targeting in human cells. Science 300, 763 (2003).

Mussolino, C. et al. A novel TALE nuclease scaffold enables high genome editing activity in combination with low toxicity. Nucleic acids research 39, 9283-9293 (2011).

Nathwani, A. C., et al., Adenovirus-associated virus vector-mediated gene transfer in hemophilia B. N Engl J Med. 2011 Dec. 22; 365(25):2357-65. doi: 10.1056/NEJMoa1108046. Epub 2011 Dec. 10.

Oliveira, T. Y. et al. Translocation capture sequencing: a method for high throughput mapping of chromosomal rearrangements. J Immunol Methods 375, 176-181 (2012).

Perez, E. E. et al. Establishment of HIV-1 resistance in CD4(+) T cells by genome editing using zinc-finger nucleases. Nat Biotechnol 26, 808-816 (2008).

Qi, L. S. et al. Repurposing CRISPR as an RNA-guided platform for sequence-specific control of gene expression. Cell 152, 1173-1183 (2013).

REMINGTON'S PHARMACEUTICAL SCIENCES (Mack Pub. Co., N.J. 1991)

Reyon, D. et al. FLASH assembly of TALENs for high-throughput genome editing. Nat Biotechnol 30, 460-465 (2012).

Saleh-Gohari, N. & Helleday, T. Conservative homologous recombination preferentially repairs DNA double-strand breaks in the S phase of the cell cycle in human cells. Nucleic Acids Res 32, 3683-3688 (2004).

Sander, J. D. et al. Selection-free zinc-finger-nuclease engineering by context-dependent assembly (CoDA). Nat Methods 8, 67-69 (2011).

Sanjana, N. E. et al. A transcription activator-like effector toolbox for genome engineering. Nat Protoc 7, 171-192 (2012).

Sapranauskas, R. et al. The *Streptococcus thermophilus* CRISPR-Cas system provides immunity in *Escherichia coli*. Nucleic Acids Res 39, 9275-9282 (2011).

Shen, B. et al. Generation of gene-modified mice via Cas9/RNA-mediated gene targeting. Cell Res 23, 720-723 (2013).

Smithies, O., Gregg, R. G., Boggs, S. S., Koralewski, M. A. & Kucherlapati, R. S. Insertion of DNA sequences into the human chromosomal beta-globin locus by homologous recombination. Nature 317, 230-234 (1985).

Soldner, F. et al. Generation of isogenic pluripotent stem cells differing exclusively at two early onset Parkinson point mutations. Cell 146, 318-331 (2011).

Takasu, Y. et al. Targeted mutagenesis in the silkworm *Bombyx mori* using zinc finger nuclease mRNA injection. Insect Biochem Molec 40, 759-765 (2010).

Tangri S, et al., Rationally engineered therapeutic proteins with reduced immunogenicity, J Immunol. 2005 Mar. 15; 174(6):3187-96.

Thomas, K. R., Folger, K. R. & Capecchi, M. R. High frequency targeting of genes to specific sites in the mammalian genome. Cell 44, 419-428 (1986).

Tuschl, T. Expanding small RNA interference. Nat Biotechnol 20, 446-448 (2002).

Urnov, F. D., Rebar, E. J., Holmes, M. C., Zhang, H. S. & Gregory, P. D. Genome editing with engineered zinc finger nucleases. Nat Rev Genet 11, 636-646 (2010).

Valton, J. et al. Overcoming transcription activator-like effector (TALE) DNA binding domain sensitivity to cytosine methylation. J Biol Chem 287, 38427-38432 (2012).

Wang, H. et al. One-Step Generation of Mice Carrying Mutations in Multiple Genes by CRISPR-Cas-Mediated Genome Engineering. Cell 153, 910-918 (2013).

Watanabe, T. et al. Non-transgenic genome modifications in a hemimetabolous insect using zinc-finger and TAL effector nucleases. Nat Commun 3 (2012).

Wilson, E. B. Probable inference, the law of succession, and statistical inference. J Am Stat Assoc 22, 209-212 (1927).

Wood, A. J. et al. Targeted genome editing across species using ZFNs and TALENs. Science 333, 307 (2011).

Wu, S., Ying, G. X., Wu, Q. & Capecchi, M. R. A protocol for constructing gene targeting vectors: generating knockout mice for the cadherin family and beyond. Nat Protoc 3, 1056-1076 (2008).

Yan H. et al. Sodium taurocholate cotransporting polypeptide is a functional receptor for human hepatitis B and D virus. eLife 1, (2012).

Zhang, F. et al. Efficient construction of sequence-specific TAL effectors for modulating mammalian transcription. Nat Biotechnol 29, 149-153 (2011).

The invention is further described by the following numbered paragraphs:

A method of modifying an organism or a non-human organism by manipulation of a target hepatitis B virus (HBV) sequence in a genomic locus of interest comprising delivering a non-naturally occurring or engineered composition comprising:

A)—I. a CRISPR-Cas system RNA polynucleotide sequence, wherein the polynucleotide sequence comprises:

(a) a guide sequence capable of hybridizing to a target HBV sequence in a eukaryotic cell, (b) a tracr mate sequence, and (c) a tracr sequence, and II. a polynucleotide sequence encoding a CRISPR enzyme, optionally comprising at least one or more nuclear localization sequences, wherein (a), (b) and (c) are arranged in a 5' to 3' orientation, wherein when transcribed, the tracr mate sequence hybridizes to the tracr sequence and the guide sequence directs sequence-specific binding of a CRISPR complex to the target HBV sequence, and wherein the CRISPR complex comprises the CRISPR enzyme complexed with (1) the guide sequence that is hybridized or hybridizable to the target HBV sequence, and (2) the tracr mate sequence that is hybridized or hybridizable to the tracr sequence and the polynucleotide sequence encoding a CRISPR enzyme is DNA or RNA, or (B) I. polynucleotides comprising:

(a) a guide sequence capable of hybridizing to a target HBV sequence in a eukaryotic cell, and (b) at least one or more tracr mate sequences, II. a polynucleotide sequence encoding a CRISPR enzyme, and III. a polynucleotide sequence comprising a tracr sequence, wherein when transcribed, the tracr mate sequence hybridizes to the tracr sequence and the guide sequence directs sequence-specific binding of a CRISPR complex to the target HBV sequence, and wherein the CRISPR complex comprises the CRISPR enzyme complexed with (1) the guide sequence that is hybridized or hybridizable to the target HBV sequence, and (2) the tracr mate sequence that is hybridized or hybridizable to the tracr sequence, and the polynucleotide sequence encoding a CRISPR enzyme is DNA or RNA.

2. The method of paragraph 1, wherein any or all of the polynucleotide sequence encoding a CRISPR enzyme, guide sequence, tracr mate sequence or tracr sequence, is/are RNA.

3. The method of paragraph 1 or 2, wherein the polynucleotides encoding the sequence encoding a CRISPR enzyme, the guide sequence, tracr mate sequence or tracr sequence is/are RNA and are delivered via liposomes, nanoparticles, exosomes, microvesicles, or a gene-gun.

4. The method of any of paragraphs 1 to 3, wherein the polynucleotides are comprised within a vector system comprising one or more vectors.

5. A method of modifying an organism or a non-human organism by manipulation of a target HBV sequence in a genomic locus of interest comprising delivering a non-naturally occurring or engineered composition comprising a viral vector system comprising one or more viral vectors operably encoding a composition for expression thereof, wherein the composition comprises:

(A) a non-naturally occurring or engineered composition comprising a vector system comprising one or more vectors comprising
  I. a first regulatory element operably linked to a CRISPR-Cas system RNA polynucleotide sequence, wherein the polynucleotide sequence comprises
    (a) a guide sequence capable of hybridizing to a target HBV sequence in a eukaryotic cell,
    (b) a tracr mate sequence, and
    (c) a tracr sequence, and
  II. a second regulatory element operably linked to an enzyme-coding sequence encoding a CRISPR enzyme, optionally comprising at least one or more nuclear localization sequences,
  wherein (a), (b) and (c) are arranged in a 5' to 3' orientation,
  wherein components I and II are located on the same or different vectors of the system,
  wherein when transcribed, the tracr mate sequence hybridizes to the tracr sequence and the guide sequence directs sequence-specific binding of a CRISPR complex to the target HBV sequence, and
  wherein the CRISPR complex comprises the CRISPR enzyme complexed with (1) the guide sequence that is hybridized or hybridizable to the target HBV sequence, and (2) the tracr mate sequence that is hybridized or hybridizable to the tracr sequence,
or
(B) a non-naturally occurring or engineered composition comprising a vector system comprising one or more vectors comprising
  I. a first regulatory element operably linked to
    (a) a guide sequence capable of hybridizing to a target HBV sequence in a eukaryotic cell, and
    (b) at least one or more tracr mate sequences,
  II. a second regulatory element operably linked to an enzyme-coding sequence encoding a CRISPR enzyme, and
  III. a third regulatory element operably linked to a tracr sequence,
  wherein components I, II and III are located on the same or different vectors of the system,
  wherein when transcribed, the tracr mate sequence hybridizes to the tracr sequence and the guide sequence directs sequence-specific binding of a CRISPR complex to the target HBV sequence, and
  wherein the CRISPR complex comprises the CRISPR enzyme complexed with (1) the guide sequence that is hybridized or hybridizable to the target HBV sequence, and (2) the tracr mate sequence that is hybridized or hybridizable to the tracr sequence.

6. The method of paragraph 5, wherein one or more of the viral vectors are delivered via liposomes, nanoparticles, exosomes, microvesicles, or a gene-gun.

7. A method of treating or inhibiting a condition caused by a defect in a target HBV sequence in a genomic locus of interest in a subject or a non-human subject in need thereof comprising modifying the subject or a non-human subject by manipulation of the target HBV sequence and wherein the condition is susceptible to treatment or inhibition by manipulation of the target HBV sequence comprising providing treatment comprising:
delivering a non-naturally occurring or engineered composition comprising an AAV or lentivirus vector system, comprising one or more AAV or lentivirus vectors operably encoding a composition for expression thereof, wherein the target HBV sequence is manipulated by the composition when expressed, wherein the composition comprises:
(A) a non-naturally occurring or engineered composition comprising a vector system comprising one or more vectors comprising
  I. a first regulatory element operably linked to a CRISPR-Cas system RNA polynucleotide sequence, wherein the polynucleotide sequence comprises
    (a) a guide sequence capable of hybridizing to a target HBV sequence in a eukaryotic cell,
    (b) a tracr mate sequence, and
    (c) a tracr sequence, and
  II. a second regulatory element operably linked to an enzyme-coding sequence encoding a CRISPR enzyme comprising at least one or more nuclear localization sequences,
  wherein (a), (b) and (c) are arranged in a 5' to 3' orientation,
  wherein components I and II are located on the same or different vectors of the system,
  wherein when transcribed, the tracr mate sequence hybridizes to the tracr sequence and the guide sequence directs sequence-specific binding of a CRISPR complex to the target HBV sequence, and
  wherein the CRISPR complex comprises the CRISPR enzyme complexed with (1) the guide sequence that is hybridized or hybridizable to the target HBV sequence, and (2) the tracr mate sequence that is hybridized or hybridizable to the tracr sequence,
or
(B) a non-naturally occurring or engineered composition comprising a vector system comprising one or more vectors comprising
  I. a first regulatory element operably linked to
    (a) a guide sequence capable of hybridizing to a target HBV sequence in a eukaryotic cell, and
    (b) at least one or more tracr mate sequences,
  II. a second regulatory element operably linked to an enzyme-coding sequence encoding a CRISPR enzyme, and
  III. a third regulatory element operably linked to a tracr sequence,
  wherein components I, II and III are located on the same or different vectors of the system,
  wherein when transcribed, the tracr mate sequence hybridizes to the tracr sequence and the guide sequence directs sequence-specific binding of a CRISPR complex to the target HBV sequence, and
  wherein the CRISPR complex comprises the CRISPR enzyme complexed with (1) the guide sequence that is hybridized or hybridizable to the target HBV sequence, and (2) the tracr mate sequence that is hybridized or hybridizable to the tracr sequence.

8. The method of any preceding claim, wherein the method is carried out in vitro, and/or ex vivo.

9. The method of any preceding claim including inducing expression.

10. The method of any preceding claim wherein the organism or subject is a eukaryote, preferably a non-human eukaryote.

11. The method of paragraph 10 wherein the organism or subject is a non-human eukaryote.

12. The method of any of paragraphs 1 to 11 wherein the organism or subject is a mammal or a non-human mammal.
13. The method of any of paragraphs 4 to 8 wherein the viral vector is an AAV or lentiviral vector.
14. The method according to any preceding claim wherein the CRISPR enzyme is a Cas9.
15. The method according to any preceding claim wherein expression of the guide sequence is under the control of the T7 promoter and is driven by the expression of T7 polymerase.
16. A method of delivering a CRISPR enzyme of any preceding claim, comprising delivering to a cell mRNA encoding the CRISPR enzyme.
17. The method of any one of paragraphss 1 to 16, wherein the polynucleotide or enzyme coding sequence encoding the CRISPR enzyme is delivered to the cell by delivering mRNA encoding the CRISPR enzyme to the cell.
18. A method of preparing the AAV or lentivirus vector of paragraph 7 comprising transfecting plasmid(s) containing or consisting essentially of nucleic acid molecule(s) coding for the AAV or lentivirus into AAV-infected or lentivirus-infected cells, and supplying AAV AAV or lentivirus rep and/or cap and/or helper nucleic acid molecules obligatory for replication and packaging of the AAV or lentivirus.
19. A method of preparing an AAV or lentivirus vector for use in the method of paragraph 7, comprising transfecting plasmid(s) containing or consisting essentially of nucleic acid molecule(s) coding for the AAV or lentivirus into AAV-infected or lentivirus-infected cells, and supplying AAV AAV or lentivirus rep and/or cap and/or helper nucleic acid molecules obligatory for replication and packaging of the AAV or lentivirus.
20. The method of paragraph 18 or 19 wherein the AAV or lentivirus rep and/or cap obligatory for replication and packaging of the AAV or lentivirus are supplied by transfecting the cells with helper plasmid(s) or helper virus(es).
21. The method of paragrpah 20 wherein the helper virus is a poxvirus, adenovirus, lentivirus, herpesvirus or baculovirus.
22. The method of paragraph 21 wherein the poxvirus is a vaccinia virus.
23. The method of any of paragraphs 18 to 22 wherein the cells are mammalian cells.
24. The method of any of paragraphs 18 to 22 wherein the cells are insect cells and the helper virus (where present) is baculovirus.
25. The method of any of paragraphs 1 to 15 wherein the target HBV sequence is flanked at its 3' end or followed by 5'-NRG (where N is any Nucleotide), and where the CRISPR enzyme is (or is derived from) S. pyogenes or S. aureus Cas9.
26. A composition as defined in any of paragraphs 1-25 for use in medicine or in therapy.
27. A composition as defined in any of paragraphs 1-25 for use in a method of modifying an organism or a non-human organism by manipulation of a target HBV sequence in a genomic locus of interest or in a method of treating or inhibiting a condition caused by a defect in a target HBV sequence in a genomic locus of interest.
28. Use of a composition as defined in any of paragraphs 1-25 in ex vivo gene or genome editing.
29. Use of a composition as defined in any of paragrpahs 1-25 in the manufacture of a medicament for ex vivo gene or genome editing or for use in a method of modifying an organism or a non-human organism by manipulation of a target HBV sequence in a genomic locus of interest or in a method of treating or inhibiting a condition caused by a defect in a target HBV sequence in a genomic locus of interest.
30. A composition comprising:
    A)—I. a CRISPR-Cas system RNA polynucleotide sequence, wherein the polynucleotide sequence comprises:
        (a) a guide sequence capable of hybridizing to a target HBV sequence in a eukaryotic cell,
        (b) a tracr mate sequence, and
        (c) a tracr sequence, and
    II. a polynucleotide sequence encoding a CRISPR enzyme, optionally comprising at least one or more nuclear localization sequences,
    wherein (a), (b) and (c) are arranged in a 5' to 3' orientation,
    wherein when transcribed, the tracr mate sequence hybridizes to the tracr sequence and the guide sequence directs sequence-specific binding of a CRISPR complex to the target HBV sequence, and
    wherein the CRISPR complex comprises the CRISPR enzyme complexed with (1) the guide sequence that is hybridized or hybridizable to the target HBV sequence, and (2) the tracr mate sequence that is hybridized or hybridizable to the tracr sequence and the polynucleotide sequence encoding a CRISPR enzyme is DNA or RNA,
    or
    (B) I. polynucleotides comprising:
        (a) a guide sequence capable of hybridizing to a target HBV sequence in a eukaryotic cell, and
        (b) at least one or more tracr mate sequences,
    II. a polynucleotide sequence encoding a CRISPR enzyme, and
    III. a polynucleotide sequence comprising a tracr sequence,
    wherein when transcribed, the tracr mate sequence hybridizes to the tracr sequence and the guide sequence directs sequence-specific binding of a CRISPR complex to the target hepatitis B virus (HBV) sequence, and
    wherein the CRISPR complex comprises the CRISPR enzyme complexed with (1) the guide sequence that is hybridized or hybridizable to the target HBV sequence, and (2) the tracr mate sequence that is hybridized or hybridizable to the tracr sequence, and the polynucleotide sequence encoding a CRISPR enzyme is DNA or RNA;
    for use in medicine or therapy; or for use in a method of modifying an organism or a non-human organism by manipulation of a target HBV sequence in a genomic locus of interest; or for use in a method of treating or inhibiting a condition caused by a defect in a target HBV sequence in a genomic locus of interest; or for use in ex vivo gene or genome editing.
31. The composition of claim 30, wherein the polynucleotides are comprised within a vector system comprising one or more vectors.
32. The method, use or composition of any of the preceding claims, wherein the CRISPR-Cas system RNA is a chimeric RNA (chiRNA).
33. The method, use or composition of any of the preceding claims, wherein the CRISPR-Cas system is a multiplexed CRISPR enzyme system further comprising multiple chimeras and/or multiple multiguide sequences and a single tracr sequence.
34. The method, use or composition according any of the preceding claims, wherein the CRISPR enzyme is a nuclease directing cleavage of one or both strands at the location of the target sequence.
35. The method, use or composition according to any of the preceding claims, wherein the CRISPR enzyme comprises one or more mutations.
36. The method, use or composition according to paragraph 35, wherein the CRISPR enzyme comprises one or more mutations D10A, E762A, H840A, N854A, N863A or D986A.
37. The method, use or composition according to paragraph 35 wherein the one or more mutations is in a RuvC1 domain of the CRISPR enzyme.
38. The method, use or composition according to paragraph 34, wherein the CRISPR enzyme is a nickase directing cleavage at the location of the target sequence.
39. The method, use or composition according to paragraph 38, wherein the nickase is a double nickase.
40. The method, use or composition according to any preceding claim further comprising at least two or more NLS.
41. The method, use or composition according to any preceding claim, wherein the CRISPR enzyme has one or more mutations in a catalytic domain, wherein when transcribed, the tracr mate sequence hybridizes to the tracr sequence and the guide sequence directs sequence-specific binding of a CRISPR complex to the target sequence, and wherein the enzyme further comprises a functional domain.
42. The method, use or composition according to paragraph 41, wherein the functional domain is a transcriptional activation domain.
43. The method, use or composition according to paragraph 42, wherein the transcriptional activation domain is VP64.
44. The method of any one of paragraphs 1-25 or 32-43 further comprising minimizing off-target modifications by manipulation of a first and a second target sequence on opposite strands of a DNA duplex in a genomic locus of interest in a cell comprising
delivering a non-naturally occurring or engineered composition comprising:
  I. a CRISPR-Cas system chimeric RNA (chiRNA) polynucleotide sequence, wherein the polynucleotide sequence comprises:
    (a) a first guide sequence capable of hybridizing to the first target sequence,
    (b) a first tracr mate sequence,
    (c) a first tracr sequence,
    (d) a second guide sequence capable of hybridizing to the second target sequence,
    (e) a second tracr mate sequence, and
    (f) a second tracr sequence, and
  optionally, wherein a linker sequence is present between the first tracr sequence and the second guide sequence, whereby the first guide sequence and the second guide sequence are in tandem; and
  II. a polynucleotide sequence encoding a CRISPR enzyme comprising at least one or more nuclear localization sequences, wherein (a), (b), (c), (d), (e) and (f) are arranged in a 5' to 3' orientation, wherein the polynucleotide sequence comprises a linker sequence between the first tracr sequence and the second guide sequence, whereby the first guide sequence and the second guide sequence are in tandem, and wherein when transcribed, the first and the second tracr mate sequence hybridize to the first and second tracr sequence respectively and the first and the second guide sequence directs sequence-specific binding of a first and a second CRISPR complex to the first and second target sequences respectively,
or
  II. a second regulatory element operably linked to an enzyme-coding sequence encoding a CRISPR enzyme, and wherein components I and II are located on the same or different vectors of the system, and when transcribed, a first tracr mate sequence hybridizes to a first tracr sequence and the first and the second guide sequence directs sequence-specific binding of a first and a second CRISPR complex to the first and second target sequences respectively;
wherein the first CRISPR complex comprises the CRISPR enzyme complexed with (1) the first guide sequence that is hybridized or hybridizable to the first target sequence, and (2) the first tracr mate sequence that is hybridized or hybridizable to the first tracr sequence,
wherein the second CRISPR complex comprises the CRISPR enzyme complexed with (1) the second guide sequence that is hybridized or hybridizable to the second target sequence, and (2) the second tracr mate sequence that is hybridized or hybridizable to the second tracr sequence,
wherein the polynucleotide sequence encoding a CRISPR enzyme is DNA or RNA, and
wherein the first guide sequence directs cleavage of one strand of the DNA duplex near the first target sequence and the second guide sequence directs cleavage of other strand near the second target sequence inducing a double strand break, thereby modifying the organism or the non-human organism by minimizing off-target modifications.
45. A CRISPR-Cas system comprising one or more vectors for delivery to a eukaryotic cell, wherein the vector(s) encode(s): (i) a CRISPR enzyme; (ii) a guide RNA capable of hybridizing to a target sequence in a viral genome within the cell; and (iii); a tracr mate sequence; and (iv) a tracr sequence,
wherein, when expressed within the cell, the guide RNA directs sequence-specific binding of a CRISPR complex to the target sequence, and the CRISPR complex comprises (a) the tracr mate sequence hybridised to the tracr sequence and (b) a CRISPR enzyme bound to the guide RNA, such that the guide RNA can hybridise to its target sequence in the viral genome.
46. The system of paragraph 45 wherein the viral genome is hepatitis B virus (HBV), herpes simplex virus (HSV), human papillomavirus (HPV), Epstein Barr virus (EBV), varicella zoster virus (VZV) or a plant virus.
47. The system of paragraph 46 wherein the viral genome is HBV.
48. A method of treating a viral infection in an individual in need thereof comprising administering an effective amount of the system of paragraph 45.
49. The method of paragraph 48 wherein the viral infection is HBV.

50. The method of paragraph 49 including administering an additional HBV treatment.

57. The method of paragraph 50 wherein the additional treatment comprises an epigenetic modifier.

52. Use of the system of any one of paragraphs 45-47 in treating a viral infection of an individual or in formulating a medicament or pharmaceutical composition or treatment regimen for viral infection treatment.

53. A method of modifying a cell of a eukaryotic organism by manipulating at least one target viral nucleic acid within the cell, the method comprising introducing into the cell an exogenous composition capable of forming a Clustered Regularly Interspersed Short Palindromic Repeats (CRISPR)-CRISPR-associated (Cas) (CRISPR-Cas) complex, the composition comprising:
  (A) CRISPR-Cas system polynucleotide sequences comprising:
    (i) a guide sequence, which when transcribed is capable of hybridizing to a sequence of the at least one target viral nucleic acid to be manipulated;
    (ii) a trans-activating CRISPR RNA (tracr) mate sequence, which is linked to the guide sequence; and
    (iii) a tracr sequence, wherein when transcribed all or a portion of the tracr sequence is capable of hybridizing to the tracr mate sequence; and
  (B) a CRISPR/Cas enzyme or a polynucleotide encoding a CRISPR/Cas enzyme,
  wherein when the CRISPR/Cas system polynucleotide sequences are present as RNA within the cell and the CRISPR/Cas enzyme is present as a protein within the cell:
    (i) the tracr mate sequence is hybridized to the tracr sequence or portion thereof,
    (ii) the CRISPR/Cas system polynucleotide sequences are associated with the CRISPR/Cas enzyme, so forming a CRISPR/Cas complex; and
    (iii) the guide sequence hybridizes to a sequence of the at least one target viral nucleic acid thereby directing sequence-specific binding of the CRISPR/Cas complex to the at least one sequence of the target viral nucleic acid, whereupon said sequence of said target viral nucleic acid is manipulated by the CRISPR/Cas enzyme of the complex.

54. An exogenous composition which, when introduced into a cell of a eukaryotic organism, is capable of forming at least one Clustered Regularly Interspersed Short Palindromic Repeats (CRISPR)-CRISPR-associated (Cas) (CRISPR-Cas) complex, wherein the complex is capable of modifying the cell by manipulating at least one target viral nucleic acid within the cell, the composition comprising:
  (A) Clustered Regularly Interspersed Short Palindromic Repeats (CRISPR)-CRISPR associated (Cas) (CRISPR-Cas) system polynucleotide sequences comprising:
    (i) a guide sequence, which when transcribed is capable of hybridizing to a sequence of the at least one target viral nucleic acid to be manipulated;
    (ii) a trans-activating CRISPR RNA (tracr) mate sequence, which is linked to the guide sequence; and
    (iii) a tracr sequence, wherein when transcribed all or a portion of the tracr sequence is capable of hybridizing with the tracr mate sequence; and
  (B) a CRISPR/Cas enzyme or a polynucleotide encoding a CRISPR/Cas enzyme,
  wherein when the CRISPR/Cas system polynucleotide sequences are present as RNA within the cell and the CRISPR/Cas enzyme is present as a protein within the cell:
    (i) the tracr mate sequence is hybridized to the tracr sequence or portion thereof;
    (ii) the CRISPR/Cas system polynucleotide sequences are associated with the CRISPR/Cas enzyme, so forming a CRISPR/Cas complex; and
    (iii) the guide sequence hybridizes to a sequence of the at least one target viral nucleic acid thereby directing sequence-specific binding of the CRISPR/Cas complex to the at least one sequence of the target viral nucleic acid, whereupon said sequence of said target viral nucleic acid is manipulated by the CRISPR/Cas enzyme of the complex.

55. A Clustered Regularly Interspersed Short Palindromic Repeats (CRISPR)-CRISPR-associated (Cas) (CRISPR-Cas) complex which, when introduced into a cell of a eukaryotic organism, is capable of modifying the cell by manipulating a target viral nucleic acid within the cell, the complex comprising:
  (A) CRISPR-Cas system RNA polynucleotide sequences comprising:
    (i) a guide sequence, which is capable of hybridizing to a sequence of the target viral nucleic acid to be manipulated;
    (ii) a trans-activating CRISPR RNA (tracr) mate sequence, which is linked to the guide sequence; and
    (iii) a tracr sequence, wherein all or a portion of the tracr sequence is capable of hybridizing with the tracr mate sequence; and
  (B) a CRISPR/Cas enzyme,
  wherein when the CRISPR/Cas system RNA polynucleotide sequences and the CRISPR/Cas enzyme are present within the cell:
    (i) the tracr mate sequence is hybridized to the tracr sequence or portion thereof,
    (ii) the CRISPR/Cas system polynucleotide sequences are associated with the CRISPR/Cas enzyme, so forming a CRISPR/Cas complex; and
    (iii) the guide sequence hybridizes to a sequence of the target viral nucleic acid thereby directing sequence-specific binding of the CRISPR/Cas complex to the sequence of the target viral nucleic acid, whereupon said sequence of said target viral nucleic acid is manipulated by the CRISPR/Cas enzyme of the complex.

56. A Clustered Regularly Interspersed Short Palindromic Repeats (CRISPR)-CRISPR-associated (Cas) (CRISPR-Cas) system chimeric RNA polynucleotide molecule (chiRNA) which, when introduced into a cell of a eukaryotic organism, is capable of associating with a CRISPR/Cas enzyme so forming a CRISPR-Cas complex, wherein the CRISPR-Cas complex is capable of modifying the cell by manipulating a target viral nucleic acid within the cell; the chiRNA comprising:
  (i) a guide sequence, which is capable of hybridizing to a sequence of the target viral nucleic acid to be manipulated;
  (ii) a trans-activating CRISPR RNA (tracr) mate sequence, which is linked to the guide sequence; and (iii) a tracr sequence, wherein all or a portion of the tracr sequence is capable of hybridizing with the tracr mate sequence; and wherein when the chiRNA and the CRISPR/Cas enzyme are present within the cell:
  a) the tracr mate sequence hybridizes to the tracr sequence or portion thereof;
  b) the chiRNA associates with the CRISPR/Cas enzyme, so forming the CRISPR/Cas complex; and
  c) the guide sequence hybridizes to a sequence of the target viral nucleic acid thereby directing sequence-specific binding of the CRISPR/Cas complex to the sequence of the target viral nucleic acid whereupon said sequence of said target viral nucleic acid is manipulated by the CRISPR/Cas enzyme of the complex.

57. A DNA polynucleotide molecule comprising sequences encoding a Clustered Regularly Interspersed Short Palindromic Repeats (CRISPR)-CRISPR-associated (Cas) (CRISPR-Cas) system chimeric RNA polynucleotide molecule (chiRNA), wherein upon introduction of said chiRNA into a cell of a eukaryotic organism said chiRNA is capable of associating with a CRISPR/Cas enzyme so forming a CRISPR-Cas complex, wherein the CRISPR-Cas complex is capable of modifying the cell by manipulating a target viral nucleic acid within the cell; the chiRNA comprising:
  (i) a guide sequence, which is capable of hybridizing to a sequence of the target viral nucleic acid to be manipulated;
  (ii) a trans-activating CRISPR RNA (tracr) mate sequence, which is linked to the guide sequence; and
  (iii) a tracr sequence, wherein all or a portion of the tracr sequence is capable of hybridizing with the tracr mate sequence; and wherein when the chiRNA and the CRISPR/Cas enzyme are present within the cell:
  a) the tracr mate sequence hybridizes to the tracr sequence or portion thereof;
  b) the chiRNA associates with the CRISPR/Cas enzyme, so forming the CRISPR/Cas complex; and
  c) the guide sequence hybridizes to a sequence of the target viral nucleic acid thereby directing sequence-specific binding of the CRISPR/Cas complex to the sequence of the target viral nucleic acid whereupon said sequence of said target viral nucleic acid is manipulated by the CRISPR/Cas enzyme of the complex.

58. The method of paragraph 53 or composition of paragraph 54, wherein the CRISPR/Cas enzyme of the exogenous composition is provided as a polynucleotide sequence which comprises either (a) RNA or (b) DNA wherein the polynucleotide sequence is operably linked to a regulatory element capable of directing expression of RNA encoding the CRISPR/Cas enzyme.

59. The method of paragraph 53 or composition of paragraph 54, wherein any of the CRISPR/Cas system polynucleotide sequences of the exogenous composition comprise either (a) RNA or (b) DNA wherein the polynucleotide sequences are operably linked to one or more regulatory elements capable of directing expression of CRISPR/Cas system RNA polynucleotide sequences.

60. The method or composition of paragraph 59, wherein each of the CRISPR/Cas system polynucleotide sequences of the exogenous composition consists of RNA and wherein the CRISPR/Cas system polynucleotide sequences comprise a chimeric RNA polynucleotide molecule comprising the guide sequence, the tracr mate sequence and the tracr sequence.

61. The method or composition of paragraph 59, wherein each of the CRISPR/Cas system polynucleotide sequences of the exogenous composition are provided as DNA polynucleotide sequences further comprising at least one regulatory element operably linked to polynucleotide sequences encoding CRISPR/Cas system RNA polynucleotide sequences and capable of directing expression thereof, and wherein the CRISPR/Cas system RNA polynucleotide sequences comprise a chimeric RNA polynucleotide molecule (chiRNA) comprising the guide sequence, the tracr mate sequence and the tracr sequence.

62. The method or composition of any of paragraphs 59 to 61, the complex of paragraph 55, the chiRNA of claim 56 or the DNA polynucleotide molecule of paragraph 57; wherein each of the guide sequence, the tracr mate sequences and the tracr sequence are arranged in a 5' to 3' orientation; or wherein each of the guide sequence, the tracr mate sequences and the tracr sequence are arranged in a 3' to 5' orientation.

63. The method or composition of any of paragraphs 58 to 62, wherein (a) the CRISPR/Cas system polynucleotide sequences or polynucleotide sequences encoding the CRISPR/Cas system polynucleotide sequences and/or (b) polynucleotide sequences encoding the CRISPR/Cas enzyme are comprised in one or more recombinant viral vectors 64. The method or composition of claim 69, wherein polynucleotide sequences of (a) are located on the same or different recombinant viral vector as polynucleotide sequences of (b).

65. The chiRNA of paragrpah 56 or the DNA polynucleotide molecule of paragraph 57 wherein the chiRNA or the DNA polynucleotide molecule is comprised in a recombinant viral vector.

66. The method, composition, chiRNA or DNA polynucleotide of any of claims 63 to 65, wherein the viral vector is a retroviral vector, optionally a lentiviral vector, a baculoviral vector, a herpes simplex virus vector, an adenoviral vector, an adenoassociated viral (AAV) vector such as AAV8 vector, or a poxvirus such as a vaccinia virus.

67. The method of any of paragraphs 58 to 62 wherein (a) the CRISPR/Cas system polynucleotide sequences or polynucleotide sequences encoding the CRISPR/Cas system polynucleotide sequences and/or (b) polynucleotide sequences encoding the CRISPR/Cas enzyme are delivered to the cell of the organism via liposomes, nanoparticles, exosomes, microvesicles or a gene-gun.

68. The method, composition, complex, chiRNA or DNA polynucleotide molecule of any of paragrpahs 53 to 67, wherein the tracr sequence is 30 or more nucleotides in length, 40 or more nucleotides in length, or 50 or more nucleotides in length.

69. The method, composition, complex, chiRNA or DNA polynucleotide molecule of any of claims 53 to 68, wherein hybridization between the tracr sequence and the tracr mate sequence produces a transcript having secondary structure, preferably a hairpin.

70. The method or composition of paragraph 69, wherein the tracr sequence comprises one or more regions capable of forming secondary structure, preferably a hairpin.

71. The method or composition of paragraph 70, wherein the tracr sequence comprises one or more hairpins, two or more hairpins, three or more hairpins, four or more hairpins, five or more hairpins, or at most five hairpins.
72. The method, composition, complex, chiRNA or DNA polynucleotide molecule of any of paragraphs 53 to 71, wherein the CRISPR/Cas enzyme is a Cas9 enzyme or a biologically active fragment or derivative thereof, such as a *Streptococcus pyogenes* Cas9 enzyme or a biologically active fragment or derivative thereof or a *Streptococcus aureus* Cas9 enzyme or a biologically active fragment or derivative thereof.
73. The method, composition, complex, chiRNA or DNA polynucleotide molecule of any of paragraphs 53 to 72, wherein the CRISPR/Cas enzyme further comprises one or more nuclear localization sequences (NLSs) capable of driving the accumulation of the CRISPR/Cas enzyme to a detectible amount in the nucleus of the cell of the organism.
74. The method, composition, complex, chiRNA or DNA polynucleotide molecule of claim 73, wherein the CRISPR/Cas enzyme comprises two or more NLSs, three or more NLSs, four or more NLSs, five or more NLSs, six or more NLSs, seven or more NLSs, eight or more NLSs, nine or more NLSs, or ten or more NLSs.
75. The method, composition, complex, chiRNA or DNA polynucleotide molecule of claim 73 or 74, wherein the CRISPR/Cas enzyme comprises at least one NLS at or near the amino-terminus of the CRISPR/Cas enzyme and/or at least one NLS at or near the carboxy-terminus the CRISPR/Cas enzyme.
76. The method, composition, complex, chiRNA or DNA polynucleotide molecule of any of claims 53 to 75, wherein when present as RNA within the cell the guide sequence is capable of hybridizing to a sequence of the target viral nucleic acid which is comprised in an episomal nucleic acid molecule which is not integrated into the genome of the organism and wherein said manipulation is a manipulation of the episomal viral nucleic acid molecule, preferably wherein the episomal nucleic acid molecule is a double-stranded DNA polynucleotide molecule.
77. The method, composition, complex, chiRNA or DNA polynucleotide molecule of claim 76, wherein the episomal viral nucleic acid molecule is a covalently closed circular DNA (cccDNA).
78. The method, composition, complex, chiRNA or DNA polynucleotide molecule of paragraph 76 or paragraph 77, wherein the CRISPR/Cas complex is capable of reducing the amount of episomal viral nucleic acid molecule in a cell of the organism compared to the amount of episomal viral nucleic acid molecule in a cell of the organism in the absence of providing the complex.
79. The method, composition, complex, chiRNA or DNA polynucleotide molecule of any of paragraphs 76 to 78, wherein the CRISPR/Cas complex is capable of manipulating the episomal nucleic acid molecule to promote degradation of the episomal nucleic acid molecule.
80. The method, composition, complex, chiRNA or DNA polynucleotide molecule of any of paragraphs 1 to 75, wherein when present as RNA within in the cell the guide sequence is capable of hybridizing to a sequence of the target viral nucleic acid which is integrated into the genome of the organism and wherein said manipulation is a manipulation of the integrated target nucleic acid.
81. The method, composition, complex, chiRNA or DNA polynucleotide molecule of claim 80, wherein when formed within the cell the CRISPR/Cas complex is capable of manipulating the integrated nucleic acid to promote excision of all or part of the target viral nucleic acid from the genome of the organism.
82. The use of a composition, complex, chiRNA or DNA polynucleotide molecule of any of paragraphs 54 to 66 or any of paragraphs 68 to 81 in the manipulation of at least one target viral nucleic acid within the cell of a eukaryotic organism.
83. The method, composition, complex, chiRNA, DNA polynucleotide molecule or use of any of paragraphs 53 to 82, wherein said at least one target viral nucleic acid is comprised in a double-stranded DNA polynucleotide cccDNA molecule and/or viral DNA integrated into the genome of the organism and wherein said manipulation of the at least one target viral nucleic acid by the CRISPR-Cas complex comprises cleavage of viral cccDNA and/or integrated viral DNA.
84. The method, composition, complex, chiRNA, DNA polynucleotide molecule or use of paragraph 83, wherein said cleavage comprises one or more double-strand break(s) introduced into the viral cccDNA and/or integrated viral DNA, optionally at least two double-strand break(s).
85. The method, composition, complex, chiRNA, DNA polynucleotide molecule or use of paragraph 83, wherein said cleavage is via one or more single-strand break(s) introduced into the viral cccDNA and/or integrated viral DNA, optionally at least two single-strand break(s).
86. The method, composition, complex, chiRNA, DNA polynucleotide molecule or use of paragraph 84 or 85, wherein said one or more double-strand break(s) or said one or more single-strand break(s) leads to the formation of one or more insertion and deletion mutations (INDELs) in the viral cccDNA sequences and/or integrated viral DNA sequences.
87. The method, composition, complex, chiRNA, DNA polynucleotide molecule or use of paragraphs 83 to 86, wherein cleavage of the viral cccDNA sequences or viral DNA sequences integrated in the genome of the organism leads to excision of viral polynucleotide sequences from the cccDNA thereby reducing viral infection or excision of viral DNA sequences from the genome of the organism thereby reducing viral infection.
88. The method or composition of paragraph 87, wherein said composition comprises components of at least two types of CRISPR/Cas complex, wherein each type of complex comprises a guide sequence capable of hybridizing to different sequences of the target nucleic acid, wherein said cleavage is cleavage of first and second strands of the viral DNA via at least two double-strand breaks introduced into the viral cccDNA and/or into or adjacent viral DNA integrated into the genome of the organism; wherein a first double-strand break is introduced at a first position of the DNA by manipulating a first target sequence and a second double-strand break is introduced at a second position of the DNA by manipulating a second target sequence; wherein upon introduction of first and second double-strand breaks viral sequences between first and second double-strand breaks are excised from cccDNA and/or from the genomic DNA of the organism.

89. The method or composition of paragraph 87, wherein said composition comprises components of at least four types of CRISPR/Cas complex, wherein each type of complex comprises a guide sequence capable of hybridizing to different sequences of the target nucleic acid, wherein said cleavage is via at least two pairs of single-strand breaks introduced into the viral cccDNA and/or introduced into or adjacent viral DNA integrated into the genome of the organism;
   wherein to introduce a first pair of single-strand breaks a first single-strand break is introduced into a first strand of DNA by manipulating a first target sequence to create a first nick and a second single-strand break is introduced into the opposite strand of DNA by manipulating a second target sequence to create a second nick;
   wherein to introduce a second pair of single-strand breaks a third single-strand break is introduced into said first strand of DNA by manipulating a third target sequence to create a third nick and a fourth single-strand break is introduced into said opposite strand of DNA by manipulating a fourth target sequence to create a fourth nick;
   wherein upon introduction of first and second pairs of single-strand breaks viral sequences between first and second pairs of single-strand breaks are excised from cccDNA and/or from the genomic DNA of the organism.

90. The method or composition of paragraph 89, wherein first and second nicks are offset relative to each other by at least one base pair so creating a first overhang, and wherein third and fourth nicks are offset relative to each other by at least one base pair so creating a second overhang.

91. The method of composition of paragraph 88, 89 or 90, wherein following excision of viral sequences the ends of the cleaved first strand of DNA are ligated together and the ends of the cleaved second strand of DNA are ligated together thus reforming unbroken first and second strands.

92. The method, composition, complex, chiRNA, DNA polynucleotide molecule or use of any of paragraphs 85 to 87, 89, 90 or 91, wherein said single-strand break(s) is introduced into DNA by a nickase enzyme which is a modified Cas9 enzyme comprising a substitution leading to catalytic inactivation of the HNH nuclease domain or the RuvC nuclease domain of Cas9; optionally wherein the substitution is at position D10 of SpCas9, preferably a D10A substitution or substitution of a residue corresponding to position D10 in a SpCas9-related enzyme, or wherein the substitution is at position H840 of SpCas9, preferably a H840A substitution or substitution of a residue corresponding to position H840 in a SpCas9-related enzyme.

93. The method, composition, complex, chiRNA, DNA polynucleotide molecule or use of any of paragraphs 53 to 82, wherein said target viral nucleic acid is cccDNA and/or viral DNA integrated into the genome of the organism and wherein said manipulation comprises insertion of one or more nucleotides into or adjacent viral cccDNA sequences or integrated viral DNA sequences, deletion of one or more nucleotides of viral cccDNA or integrated viral DNA, translocation of viral cccDNA sequences or integrated viral DNA sequences, repression of transcription of viral cccDNA sequences or integrated viral DNA sequences, and/or inactivation of viral cccDNA sequences or integrated viral DNA sequences.

94. The method, composition, complex, chiRNA, DNA polynucleotide molecule or use of claim 92, wherein repression of transcription of viral cccDNA sequences and/or integrated viral DNA sequences is effected by a CRISPR-Cas system comprising a CRISPR enzyme fused to one or more transcriptional repressor domains, optionally wherein the one or more transcriptional repressor domains comprises KRAB, SID and/or SID4×, preferably wherein the CRISPR enzyme is a Cas9 enzyme.

95. The method, composition, complex, chiRNA, DNA polynucleotide molecule or use of any of paragraphs 83 to 93, wherein said manipulation of nucleotide sequences of viral cccDNA or integrated viral DNA leads to disruption of one or more viral open reading frames, disruption of viral mRNA expression and/or inhibition of the production of functional virions.

96. The method, composition, complex, chiRNA, DNA polynucleotide molecule or use of any of paragraphs 83 to 93, wherein manipulation of said viral cccDNA leads to a reduction in the level of one or more of viral rcDNA, viral cccDNA and viral ssDNA compared to the level in the absence of the CRISPR/Cas complex.

97. The method, composition, complex, chiRNA, DNA polynucleotide molecule or use of any of paragraphs 83 to 95, wherein the effect of said manipulation comprises inhibiting the production of new virions.

98. The method, composition, complex, chiRNA, DNA polynucleotide molecule or use of any of paragraphs 83 to 96, wherein the effect of said modifying comprises removing viral sequences from said organism thereby reducing viral infection.

99. The method or composition of any of paragraphs 53, 54, 58 to 87 and 93 to 98, wherein said composition further comprises components of one or more additional CRISPR/Cas complexes, wherein each type of complex comprises a different guide sequence capable hybridizing to a different sequence of the target nucleic acid within the cell.

100. The method, composition, complex, chiRNA, DNA polynucleotide molecule or use of any of paragraphs 53 to 99 wherein the target viral nucleic acid is a hepatitis B virus (HBV) nucleic acid, preferably wherein the cell expresses the sodium taurocholate cotransporting polypeptide (NTCP) or wherein the cell is a hepatocyte, preferably a primary hepatocyte, more preferably a human hepatocyte or a human primary hepatocyte, a HepG2.2.15 or a HepG2-hNTCP cell.

101. The method, composition, complex, chiRNA, DNA polynucleotide molecule or use of claim 100, wherein the guide sequence is capable of hybridizing with target viral nucleic acids of HBV ORF S, ORF C, ORF P, or ORF X, preferably ORF C.

102. The method, composition, complex, chiRNA or DNA polynucleotide molecule of paragraph 100 or claim 101, wherein the sequence of the guide sequence comprises 5'-gggcgcacctctctttacg-3' (SEQ ID NO: 1750), 5'-cctctgccgatccatactg-3' (SEQ ID NO: 1472) or 5'-taaagaatttggagctactg-3' (SEQ ID NO: 1566).

103. The method, composition, complex, chiRNA, DNA polynucleotide molecule or use of any of paragrpahs 53 to 99 wherein the target viral nucleic acid is a human papillomavirus (HPV) nucleic acid, an Epstein Barr virus (EBV) nucleic acid or a varicella zoster virus (VZV) nucleic acid.

104. The method, composition, complex, chiRNA, DNA polynucleotide molecule or use of any of paragraphs 53 to 103 wherein said manipulation is performed in vitro or ex vivo.

105. The composition, complex, chiRNA or DNA polynucleotide molecule according to any of paragraphs 54 to 66 and 68-99 for use as a medicament.

106. The composition, complex or chiRNA or DNA polynucleotide molecule according to any of paragraphs 54 to 66 and 68-99 for use in the treatment of a viral infection.

107. The composition, complex or chiRNA or DNA polynucleotide molecule for use according to paragraph 106, wherein the viral infection is caused by hepatitis B virus (HBV).

108. The composition, complex or chiRNA or DNA polynucleotide molecule for use according to paragraph 106, wherein the viral infection is caused by human papillomavirus (HPV), Epstein Barr virus (EBV) or varicella zoster virus (VZV).

109. The composition, complex or chiRNA or DNA polynucleotide molecule for use according to any of paragraphs 104 to 108 wherein said organism is a mammal.

110. The composition, complex or chiRNA or DNA polynucleotide molecule for use according to paragraph 109 wherein said mammal is a human.

111. The use of a composition, complex, chiRNA or DNA according to any of paragraph 54 to 66 or 68-99 in the manufacture of a medicament.

112. The use of a composition, complex, chiRNA or DNA according to any of claims 54 to 66 or 68-99 in the manufacture of a medicament for the treatment of a viral infection.

113. The use according to paragraph 112, wherein the viral infection is caused by hepatitis B virus (HBV).

114. The use according to paragraph 112, wherein the viral infection is caused by human papillomavirus (HPV), Epstein Barr virus (EBV) or varicella zoster virus (VZV).

115. The use according to any of paragraphs 111 to 114 wherein said organism is a mammal.

116. The use according to paragraph 115 wherein said mammal is a human.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention.

SEQUENCE LISTING (1750 sequences)

SEQ ID NO: 1 - DNA, 23 bp, Artificial Sequence
  source: /note="Description of Artificial Sequence: Synthetic oligonucleotide"
  modified_base (1)..(20): a, c, t or g
  modified_base (21)..(21): a, c, t, g, unknown or other
nnnnnnnnnnnnnnnnnnnnngg

SEQ ID NO: 2 - DNA, 15 bp, Artificial Sequence
  source: /note="Description of Artificial Sequence: Synthetic oligonucleotide"
  modified_base (1)..(12): a, c, t or g
  modified_base (13)..(13): a, c, t, g, unknown or other
nnnnnnnnnnnnngg

SEQ ID NO: 3 - DNA, 23 bp, Artificial Sequence
  source: /note="Description of Artificial Sequence: Synthetic oligonucleotide"
  modified_base (1)..(20): a, c, t or g
  modified_base (21)..(21): a, c, t, g, unknown or other
nnnnnnnnnnnnnnnnnnnnngg

SEQ ID NO: 4 - DNA, 14 bp, Artificial Sequence
  source: /note="Description of Artificial Sequence: Synthetic oligonucleotide"
  modified_base (1)..(11): a, c, t or g
  modified_base (12)..(12): a, c, t, g, unknown or other
nnnnnnnnnnnngg

SEQ ID NO: 5 - DNA, 27 bp, Artificial Sequence
  source: /note="Description of Artificial Sequence: Synthetic oligonucleotide"
  modified_base (1)..(20): a, c, t or g
  modified_base (21)..(22): a, c, t, g, unknown or other
nnnnnnnnnnnnnnnnnnnnnnagaaw

SEQ ID NO: 6 - DNA, 19 bp, Artificial Sequence
  source: /note="Description of Artificial Sequence: Synthetic oligonucleotide"
  modified_base (1)..(12): a, c, t or g
  modified_base (13)..(14): a, c, t, g, unknown or other
nnnnnnnnnnnnnnagaaw

SEQ ID NO: 7 - DNA, 27 bp, Artificial Sequence
  source: /note="Description of Artificial Sequence: Synthetic oligonucleotide"
  modified_base (1)..(20): a, c, t or g
  modified_base (21)..(22): a, c, t, g, unknown or other
nnnnnnnnnnnnnnnnnnnnnnagaaw

SEQ ID NO: 8 - DNA, 18 bp, Artificial Sequence
  source: /note="Description of Artificial Sequence: Synthetic oligonucleotide"
  modified_base (1)..(11): a, c, t or g
  modified_base (12)..(13): a, c, t, g, unknown or other
nnnnnnnnnnnnnagaaw

SEQ ID NO: 9 - DNA, 25 bp, Artificial Sequence
  source: /note="Description of Artificial Sequence: Synthetic oligonucleotide"
  modified_base (1)..(20): a, c, t or g
  modified_base (21)..(21): a, c, t, g, unknown or other
  modified_base (24)..(24): a, c, t, g, unknown or other
nnnnnnnnnnnnnnnnnnnnnggng

SEQ ID NO: 10 - DNA, 17 bp, Artificial Sequence
  source: /note="Description of Artificial Sequence: Synthetic oligonucleotide"
  modified_base (1)..(12): a, c, t or g
  modified_base (13)..(13): a, c, t, g, unknown or other
  modified_base (16)..(16): a, c, t, g, unknown or other
nnnnnnnnnnnnnggng

SEQ ID NO: 11 - DNA, 25 bp, Artificial Sequence
  source: /note="Description of Artificial Sequence: Synthetic oligonucleotide"
  modified_base (1)..(20): a, c, t or g
  modified_base (21)..(21): a, c, t, g, unknown or other
  modified_base (24)..(24): a, c, t, g, unknown or other
nnnnnnnnnnnnnnnnnnnnnggng

SEQ ID NO: 12 - DNA, 16 bp, Artificial Sequence
  source: /note="Description of Artificial Sequence: Synthetic oligonucleotide"
  modified_base (1)..(11): a, c, t or g
  modified_base (12)..(12): a, c, t, g, unknown or other
  modified_base (15)..(15): a, c, t, g, unknown or other
nnnnnnnnnnnnggng

SEQ ID NO: 13 - DNA, 137 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttttgtactctcaagatttagaaataaatcttgcagaagctacaaagataaggcttcatgccgaaatcaacaccctgtcattttatggcagggtgttttcgttatttaatttttt

SEQ ID NO: 14 - DNA, 123 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttttgtactctcagaaatgcagaagctacaaagataaggcttcatgccgaaatcaacaccctgtcattttatggcagggtgttttcgttatttaatttttt

SEQ ID NO: 15 - DNA, 110 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngtttttgtactctcagaaatgcagaagctacaaagataaggcttcatgccgaaatcaacaccctgtcattttatggcagggtgttttttt

SEQ ID NO: 16 - DNA, 102 bp, Artificial Sequence
  source: /note="Description of Artificial Sequence: Synthetic polynucleotide"
  modified_base (1)..(20): a, c, t, g, unknown or other
nnnnnnnnnnnnnnnnnnnngttttagagctagaaatagcaagttaaaataaggctagtccgttatcaacttgaaaaagtggcaccgagtcggtgctttttt

SEQ ID NO: 17 - DNA, 88 bp, Artificial Sequence
  source: /note="Description of Artificial Sequence: Synthetic oligonucleotide"
  modified_base (1)..(20): a, c, t, g, unknown or other
nnnnnnnnnnnnnnnnnnnngttttagagctagaaatagcaagttaaaataaggctagtccgttatcaacttgaaaaagtgttttttt

SEQ ID NO: 18 - DNA, 76 bp, Artificial Sequence
  source: /note="Description of Artificial Sequence: Synthetic oligonucleotide"
  modified_base (1)..(20): a, c, t, g, unknown or other
nnnnnnnnnnnnnnnnnnnngttttagagctagaaatagcaagttaaaataaggctagtccgttatcatttttttt

SEQ ID NO: 19 - DNA, 20 bp, Homo sapiens
gagtccgagcagaagaagaa

SEQ ID NO: 20 - DNA, 20 bp, Homo sapiens
gagtcctagcaggagaagaa

SEQ ID NO: 21 - DNA, 20 bp, Homo sapiens
gagtctaagcagaagaagaa

SEQ ID NO: 22 - protein, 7 aa, Simian virus 40
PKKKRKV

SEQ ID NO: 23 - protein, 16 aa, Unknown
  source: /note="Description of Unknown: Nucleoplasmin bipartite NLS sequence"
KRPAATKKAGQAKKKK

SEQ ID NO: 24 - protein, 9 aa, Unknown
  source: /note="Description of Unknown: C-myc NLS sequence"
PAAKRVKLD

SEQ ID NO: 25 - protein, 11 aa, Unknown
  source: /note="Description of Unknown: C-myc NLS sequence"
RQRRNELKRSP

SEQ ID NO: 26 - protein, 38 aa, Homo sapiens
NQSSNFGPMKGGNFGGRSSGPYGGGGQYFAKPRNQGGY

SEQ ID NO: 27 - protein, 42 aa, Unknown
  source: /note="Description of Unknown: IBB domain from importin-alpha sequence"
RMRIZFKNKGKDTAELRRRRVEVSVELRKAKKDEQILKRRNV

SEQ ID NO: 28 - protein, 8 aa, Unknown
  source: /note="Description of Unknown: Myoma T protein sequence"
VSRKRPRP

SEQ ID NO: 29 - protein, 8 aa, Unknown
  source: /note="Description of Unknown: Myoma T protein sequence"
PPKKARED

SEQ ID NO: 30 - protein, 8 aa, Homo sapiens
PQPKKKPL

SEQ ID NO: 31 - protein, 12 aa, Mus musculus
SALIKKKKKMAP

SEQ ID NO: 32 - protein, 5 aa, Influenza virus
DRLRR

SEQ ID NO: 33 - protein, 7 aa, Influenza virus
PKQKKRK

SEQ ID NO: 34 - protein, 10 aa, Hepatitis delta virus
RKLKKKIKKL

SEQ ID NO: 35 - protein, 10 aa, Mus musculus
REKKKFLKRR

SEQ ID NO: 36 - protein, 20 aa, Homo sapiens
KRKGDEVDGVDEVAKKKSKK

SEQ ID NO: 37 - protein, 17 aa, Homo sapiens
RKCLQAGMNLEARKTKK

SEQ ID NO: 38 - RNA, 60 nt, Artificial Sequence
  source: /note="Description of Artificial Sequence: Synthetic oligonucleotide"
  modified_base (1)..(20): a, c, u, g, unknown or other
  modified_base (23)..(44): a, c, u, g, unknown or other
  modified_base (47)..(60): a, c, u, g, unknown or other
nnnnnnnnnnnnnnnnnnnnccnnnnnnnnnnnnnnnnnnnnnnggnnnnnnnnnnnnnn

SEQ ID NO: 39 - RNA, 60 nt, Artificial Sequence
  source: /note="Description of Artificial Sequence: Synthetic oligonucleotide"
  modified_base (1)..(14): a, c, u, g, unknown or other
  modified_base (17)..(38): a, c, u, g, unknown or other
  modified_base (41)..(60): a, c, u, g, unknown or other
nnnnnnnnnnnnnnccnnnnnnnnnnnnnnnnnnnnnnggnnnnnnnnnnnnnnnnnnnn

SEQ ID NO: 40 - RNA, 60 nt, Artificial Sequence
  source: /note="Description of Artificial Sequence: Synthetic oligonucleotide"
  modified_base (1)..(20): a, c, u, g, unknown or other
  modified_base (23)..(43): a, c, u, g, unknown or other
  modified_base (46)..(60): a, c, u, g, unknown or other
nnnnnnnnnnnnnnnnnnnnccnnnnnnnnnnnnnnnnnnnnnggnnnnnnnnnnnnnnn

SEQ ID NO: 41 - RNA, 60 nt, Artificial Sequence
  source: /note="Description of Artificial Sequence: Synthetic oligonucleotide"
  modified_base (1)..(15): a, c, u, g, unknown or other
  modified_base (18)..(38): a, c, u, g, unknown or other
  modified_base (41)..(60): a, c, u, g, unknown or other
nnnnnnnnnnnnnnnccnnnnnnnnnnnnnnnnnnnnnggnnnnnnnnnnnnnnnnnnnn

SEQ ID NO: 42 - RNA, 60 nt, Artificial Sequence
  source: /note="Description of Artificial Sequence: Synthetic oligonucleotide"
  modified_base (1)..(20): a, c, u, g, unknown or other
  modified_base (23)..(42): a, c, u, g, unknown or other
  modified_base (45)..(60): a, c, u, g, unknown or other
nnnnnnnnnnnnnnnnnnnnccnnnnnnnnnnnnnnnnnnnnggnnnnnnnnnnnnnnnn

SEQ ID NO: 43 - RNA, 60 nt, Artificial Sequence; identical to SEQ ID NO: 41
  source: /note="Description of Artificial Sequence: Synthetic oligonucleotide"
  modified_base (1)..(15): a, c, u, g, unknown or other
  modified_base (18)..(38): a, c, u, g, unknown or other
  modified_base (41)..(60): a, c, u, g, unknown or other

SEQ ID NO: 44 - RNA, 60 nt, Artificial Sequence
  source: /note="Description of Artificial Sequence: Synthetic oligonucleotide"
  modified_base (1)..(20): a, c, u, g, unknown or other
  modified_base (23)..(41): a, c, u, g, unknown or other
  modified_base (44)..(60): a, c, u, g, unknown or other
nnnnnnnnnnnnnnnnnnnnccnnnnnnnnnnnnnnnnnnnggnnnnnnnnnnnnnnnnn

SEQ ID NO: 45 - RNA, 60 nt, Artificial Sequence
  source: /note="Description of Artificial Sequence: Synthetic oligonucleotide"
  modified_base (1)..(17): a, c, u, g, unknown or other
  modified_base (20)..(38): a, c, u, g, unknown or other
  modified_base (41)..(60): a, c, u, g, unknown or other
nnnnnnnnnnnnnnnnnccnnnnnnnnnnnnnnnnnnnggnnnnnnnnnnnnnnnnnnnn

SEQ ID NO: 46 - RNA, 60 nt, Artificial Sequence
  source: /note="Description of Artificial Sequence: Synthetic oligonucleotide"
  modified_base (1)..(20): a, c, u, g, unknown or other
  modified_base (23)..(40): a, c, u, g, unknown or other
  modified_base (43)..(60): a, c, u, g, unknown or other
nnnnnnnnnnnnnnnnnnnnccnnnnnnnnnnnnnnnnnnggnnnnnnnnnnnnnnnnnn

SEQ ID NO: 47 - RNA, 60 nt, Artificial Sequence
  source: /note="Description of Artificial Sequence: Synthetic oligonucleotide"
  modified_base (1)..(18): a, c, u, g, unknown or other
  modified_base (21)..(38): a, c, u, g, unknown or other
  modified_base (41)..(60): a, c, u, g, unknown or other
nnnnnnnnnnnnnnnnnnccnnnnnnnnnnnnnnnnnnggnnnnnnnnnnnnnnnnnnnn

SEQ ID NO: 48 - RNA, 60 nt, Artificial Sequence
  source: /note="Description of Artificial Sequence: Synthetic oligonucleotide"
  modified_base (1)..(20): a, c, u, g, unknown or other
  modified_base (23)..(39): a, c, u, g, unknown or other
  modified_base (42)..(60): a, c, u, g, unknown or other
nnnnnnnnnnnnnnnnnnnnccnnnnnnnnnnnnnnnnnggnnnnnnnnnnnnnnnnnnn

SEQ ID NO: 49 - RNA, 60 nt, Artificial Sequence
  source: /note="Description of Artificial Sequence: Synthetic oligonucleotide"
  modified_base (1)..(19): a, c, u, g, unknown or other
  modified_base (22)..(38): a, c, u, g, unknown or other
  modified_base (41)..(60): a, c, u, g, unknown or other
nnnnnnnnnnnnnnnnnnnccnnnnnnnnnnnnnnnnnggnnnnnnnnnnnnnnnnnnnn

SEQ ID NO: 50 - RNA, 60 nt, Artificial Sequence
  source: /note="Description of Artificial Sequence: Synthetic oligonucleotide"
  modified_base (1)..(20): a, c, u, g, unknown or other
  modified_base (23)..(38): a, c, u, g, unknown or other
  modified_base (41)..(60): a, c, u, g, unknown or other
nnnnnnnnnnnnnnnnnnnnccnnnnnnnnnnnnnnnnggnnnnnnnnnnnnnnnnnnnn

SEQ ID NO: 51 - RNA, 60 nt, Artificial Sequence; identical to SEQ ID NO: 50
  source: /note="Description of Artificial Sequence: Synthetic oligonucleotide"
  modified_base (1)..(20): a, c, u, g, unknown or other
  modified_base (23)..(38): a, c, u, g, unknown or other
  modified_base (41)..(60): a, c, u, g, unknown or other

SEQ ID NO: 52 - RNA, 60 nt, Artificial Sequence
  source: /note="Description of Artificial Sequence: Synthetic oligonucleotide"
  modified_base (1)..(20): a, c, u, g, unknown or other
  modified_base (23)..(37): a, c, u, g, unknown or other
  modified_base (40)..(60): a, c, u, g, unknown or other
nnnnnnnnnnnnnnnnnnnnccnnnnnnnnnnnnnnnggnnnnnnnnnnnnnnnnnnnnn

SEQ ID NO: 53 - RNA, 60 nt, Artificial Sequence
  source: /note="Description of Artificial Sequence: Synthetic oligonucleotide"
  modified_base (1)..(21): a, c, u, g, unknown or other
  modified_base (24)..(38): a, c, u, g, unknown or other
  modified_base (41)..(60): a, c, u, g, unknown or other
nnnnnnnnnnnnnnnnnnnnnccnnnnnnnnnnnnnnnggnnnnnnnnnnnnnnnnnnnn

SEQ ID NO: 54 - RNA, 60 nt, Artificial Sequence
  source: /note="Description of Artificial Sequence: Synthetic oligonucleotide"
  modified_base (1)..(20): a, c, u, g, unknown or other
  modified_base (23)..(36): a, c, u, g, unknown or other
  modified_base (39)..(60): a, c, u, g, unknown or other
nnnnnnnnnnnnnnnnnnnnccnnnnnnnnnnnnnnggnnnnnnnnnnnnnnnnnnnnnn

SEQ ID NO: 55 - RNA, 60 nt, Artificial Sequence
  source: /note="Description of Artificial Sequence: Synthetic oligonucleotide"
  modified_base (1)..(22): a, c, u, g, unknown or other
  modified_base (25)..(38): a, c, u, g, unknown or other
  modified_base (41)..(60): a, c, u, g, unknown or other
nnnnnnnnnnnnnnnnnnnnnnccnnnnnnnnnnnnnnggnnnnnnnnnnnnnnnnnnnn

SEQ ID NO: 56 - RNA, 60 nt, Artificial Sequence
  source: /note="Description of Artificial Sequence: Synthetic oligonucleotide"
  modified_base (1)..(20): a, c, u, g, unknown or other
  modified_base (23)..(35): a, c, u, g, unknown or other
  modified_base (38)..(60): a, c, u, g, unknown or other
nnnnnnnnnnnnnnnnnnnnccnnnnnnnnnnnnnggnnnnnnnnnnnnnnnnnnnnnnn

SEQ ID NO: 57 - RNA, 60 nt, Artificial Sequence
  source: /note="Description of Artificial Sequence: Synthetic oligonucleotide"
  modified_base (1)..(23): a, c, u, g, unknown or other
  modified_base (26)..(38): a, c, u, g, unknown or other
  modified_base (41)..(60): a, c, u, g, unknown or other
nnnnnnnnnnnnnnnnnnnnnnnccnnnnnnnnnnnnnggnnnnnnnnnnnnnnnnnnnn

SEQ ID NO: 58 - RNA, 60 nt, Artificial Sequence
  source: /note="Description of Artificial Sequence: Synthetic oligonucleotide"
  modified_base (1)..(20): a, c, u, g, unknown or other
  modified_base (23)..(34): a, c, u, g, unknown or other
  modified_base (37)..(60): a, c, u, g, unknown or other
nnnnnnnnnnnnnnnnnnnnccnnnnnnnnnnnnggnnnnnnnnnnnnnnnnnnnnnnnn

SEQ ID NO: 59 - RNA, 60 nt, Artificial Sequence
  source: /note="Description of Artificial Sequence: Synthetic oligonucleotide"
  modified_base (1)..(24): a, c, u, g, unknown or other
  modified_base (27)..(38): a, c, u, g, unknown or other
  modified_base (41)..(60): a, c, u, g, unknown or other
nnnnnnnnnnnnnnnnnnnnnnnnccnnnnnnnnnnnnggnnnnnnnnnnnnnnnnnnnn

SEQ ID NO: 60 - RNA, 60 nt, Artificial Sequence
  source: /note="Description of Artificial Sequence: Synthetic oligonucleotide"
  modified_base (1)..(20): a, c, u, g, unknown or other
  modified_base (23)..(33): a, c, u, g, unknown or other
  modified_base (36)..(60): a, c, u, g, unknown or other
nnnnnnnnnnnnnnnnnnnnccnnnnnnnnnnnggnnnnnnnnnnnnnnnnnnnnnnnnn

SEQ ID NO: 61 - RNA, 60 nt, Artificial Sequence
  source: /note="Description of Artificial Sequence: Synthetic oligonucleotide"
  modified_base (1)..(25): a, c, u, g, unknown or other
  modified_base (28)..(38): a, c, u, g, unknown or other
  modified_base (41)..(60): a, c, u, g, unknown or other
nnnnnnnnnnnnnnnnnnnnnnnnnccnnnnnnnnnnnggnnnnnnnnnnnnnnnnnnnn

SEQ ID NO: 62 - RNA, 60 nt, Artificial Sequence
  source: /note="Description of Artificial Sequence: Synthetic oligonucleotide"
  modified_base (1)..(20): a, c, u, g, unknown or other
  modified_base (23)..(32): a, c, u, g, unknown or other
  modified_base (35)..(60): a, c, u, g, unknown or other
nnnnnnnnnnnnnnnnnnnnccnnnnnnnnnnggnnnnnnnnnnnnnnnnnnnnnnnnnn

SEQ ID NO: 63 - RNA, 60 nt, Artificial Sequence
  source: /note="Description of Artificial Sequence: Synthetic oligonucleotide"
  modified_base (1)..(26): a, c, u, g, unknown or other
  modified_base (29)..(38): a, c, u, g, unknown or other
  modified_base (41)..(60): a, c, u, g, unknown or other
nnnnnnnnnnnnnnnnnnnnnnnnnnccnnnnnnnnnnggnnnnnnnnnnnnnnnnnnnn

SEQ ID NO: 64 - RNA, 60 nt, Artificial Sequence
  source: /note="Description of Artificial Sequence: Synthetic oligonucleotide"
  modified_base (1)..(20): a, c, u, g, unknown or other
  modified_base (23)..(31): a, c, u, g, unknown or other
  modified_base (34)..(60): a, c, u, g, unknown or other
nnnnnnnnnnnnnnnnnnnnccnnnnnnnnnggnnnnnnnnnnnnnnnnnnnnnnnnnnn

SEQ ID NO: 65 - RNA, 60 nt, Artificial Sequence
  source: /note="Description of Artificial Sequence: Synthetic oligonucleotide"
  modified_base (1)..(27): a, c, u, g, unknown or other
  modified_base (30)..(38): a, c, u, g, unknown or other
  modified_base (41)..(60): a, c, u, g, unknown or other
nnnnnnnnnnnnnnnnnnnnnnnnnnnccnnnnnnnnnggnnnnnnnnnnnnnnnnnnnn

SEQ ID NO: 66 - RNA, 60 nt, Artificial Sequence
  source: /note="Description of Artificial Sequence: Synthetic oligonucleotide"
  modified_base (1)..(20): a, c, u, g, unknown or other
  modified_base (23)..(30): a, c, u, g, unknown or other
  modified_base (33)..(60): a, c, u, g, unknown or other
nnnnnnnnnnnnnnnnnnnnccnnnnnnnnggnnnnnnnnnnnnnnnnnnnnnnnnnnnn

SEQ ID NO: 67 - RNA, 60 nt, Artificial Sequence
  source: /note="Description of Artificial Sequence: Synthetic oligonucleotide"
  modified_base (1)..(28): a, c, u, g, unknown or other
  modified_base (31)..(38): a, c, u, g, unknown or other
  modified_base (41)..(60): a, c, u, g, unknown or other
nnnnnnnnnnnnnnnnnnnnnnnnnnnnccnnnnnnnnggnnnnnnnnnnnnnnnnnnnn

SEQ ID NO: 68 - RNA, 60 nt, Artificial Sequence
  source: /note="Description of Artificial Sequence: Synthetic oligonucleotide"
  modified_base (1)..(20): a, c, u, g, unknown or other
  modified_base (23)..(29): a, c, u, g, unknown or other
  modified_base (32)..(60): a, c, u, g, unknown or other
nnnnnnnnnnnnnnnnnnnnccnnnnnnnggnnnnnnnnnnnnnnnnnnnnnnnnnnnnn

SEQ ID NO: 69 - RNA, 60 nt, Artificial Sequence
  source: /note="Description of Artificial Sequence: Synthetic oligonucleotide"
  modified_base (1)..(29): a, c, u, g, unknown or other
  modified_base (32)..(38): a, c, u, g, unknown or other
  modified_base (41)..(60): a, c, u, g, unknown or other
nnnnnnnnnnnnnnnnnnnnnnnnnnnnnccnnnnnnnggnnnnnnnnnnnnnnnnnnnn

SEQ ID NO: 70 - RNA, 60 nt, Artificial Sequence
  source: /note="Description of Artificial Sequence: Synthetic oligonucleotide"
  modified_base (1)..(20): a, c, u, g, unknown or other
  modified_base (23)..(28): a, c, u, g, unknown or other
  modified_base (31)..(60): a, c, u, g, unknown or other
nnnnnnnnnnnnnnnnnnnnccnnnnnnggnnnnnnnnnnnnnnnnnnnnnnnnnnnnnn

SEQ ID NO: 71 - RNA, 60 nt, Artificial Sequence
  source: /note="Description of Artificial Sequence: Synthetic oligonucleotide"
  modified_base (1)..(30): a, c, u, g, unknown or other
  modified_base (33)..(38): a, c, u, g, unknown or other
  modified_base (41)..(60): a, c, u, g, unknown or other
nnnnnnnnnnnnnnnnnnnnnnnnnnnnnnccnnnnnnggnnnnnnnnnnnnnnnnnnnn

SEQ ID NO: 72 - RNA, 60 nt, Artificial Sequence
  source: /note="Description of Artificial Sequence: Synthetic oligonucleotide"
  modified_base (1)..(20): a, c, u, g, unknown or other
  modified_base (23)..(27): a, c, u, g, unknown or other
  modified_base (30)..(60): a, c, u, g, unknown or other
nnnnnnnnnnnnnnnnnnnnccnnnnnggnnnnnnnnnnnnnnnnnnnnnnnnnnnnnnn

SEQ ID NO: 73 - RNA, 60 nt, Artificial Sequence
  source: /note="Description of Artificial Sequence: Synthetic oligonucleotide"
  modified_base (1)..(31): a, c, u, g, unknown or other
  modified_base (34)..(38): a, c, u, g, unknown or other
  modified_base (41)..(60): a, c, u, g, unknown or other
nnnnnnnnnnnnnnnnnnnnnnnnnnnnnnnccnnnnnggnnnnnnnnnnnnnnnnnnnn

SEQ ID NO: 74 - RNA, 60 nt, Artificial Sequence
  source: /note="Description of Artificial Sequence: Synthetic oligonucleotide"
  modified_base (1)..(20): a, c, u, g, unknown or other
  modified_base (23)..(26): a, c, u, g, unknown or other
  modified_base (29)..(60): a, c, u, g, unknown or other
nnnnnnnnnnnnnnnnnnnnccnnnnggnnnnnnnnnnnnnnnnnnnnnnnnnnnnnnnn

SEQ ID NO: 75 - RNA, 60 nt, Artificial Sequence
  source: /note="Description of Artificial Sequence: Synthetic oligonucleotide"
  modified_base (1)..(32): a, c, u, g, unknown or other
  modified_base (35)..(38): a, c, u, g, unknown or other
  modified_base (41)..(60): a, c, u, g, unknown or other
nnnnnnnnnnnnnnnnnnnnnnnnnnnnnnnnccnnnnggnnnnnnnnnnnnnnnnnnnn

SEQ ID NO: 76 - RNA, 60 nt, Artificial Sequence
  source: /note="Description of Artificial Sequence: Synthetic oligonucleotide"
  modified_base (1)..(20): a, c, u, g, unknown or other
  modified_base (23)..(25): a, c, u, g, unknown or other
  modified_base (28)..(60): a, c, u, g, unknown or other
nnnnnnnnnnnnnnnnnnnnccnnnggnnnnnnnnnnnnnnnnnnnnnnnnnnnnnnnnn

SEQ ID NO: 77 - RNA, 60 nt, Artificial Sequence
  source: /note="Description of Artificial Sequence: Synthetic oligonucleotide"
  modified_base (1)..(33): a, c, u, g, unknown or other
  modified_base (36)..(38): a, c, u, g, unknown or other
  modified_base (41)..(60): a, c, u, g, unknown or other
nnnnnnnnnnnnnnnnnnnnnnnnnnnnnnnnnccnnnggnnnnnnnnnnnnnnnnnnnn

SEQ ID NO: 78 - RNA, 60 nt, Artificial Sequence
  source: /note="Description of Artificial Sequence: Synthetic oligonucleotide"
  modified_base (1)..(20): a, c, u, g, unknown or other
  modified_base (23)..(24): a, c, u, g, unknown or other
  modified_base (27)..(60): a, c, u, g, unknown or other
nnnnnnnnnnnnnnnnnnnnccnnggnnnnnnnnnnnnnnnnnnnnnnnnnnnnnnnnnn

SEQ ID NO: 79 - RNA, 60 nt, Artificial Sequence
  source: /note="Description of Artificial Sequence: Synthetic oligonucleotide"
  modified_base (1)..(34): a, c, u, g, unknown or other
  modified_base (37)..(38): a, c, u, g, unknown or other
  modified_base (41)..(60): a, c, u, g, unknown or other
nnnnnnnnnnnnnnnnnnnnnnnnnnnnnnnnnnccnnggnnnnnnnnnnnnnnnnnnnn

SEQ ID NO: 80 - RNA, 60 nt, Artificial Sequence
  source: /note="Description of Artificial Sequence: Synthetic oligonucleotide"
  modified_base (1)..(20): a, c, u, g, unknown or other
  modified_base (23)..(23): a, c, u, g, unknown or other
  modified_base (26)..(60): a, c, u, g, unknown or other
nnnnnnnnnnnnnnnnnnnnccnggnnnnnnnnnnnnnnnnnnnnnnnnnnnnnnnnnnn

SEQ ID NO: 81 - RNA, 60 nt, Artificial Sequence
  source: /note="Description of Artificial Sequence: Synthetic oligonucleotide"
  modified_base (1)..(35): a, c, u, g, unknown or other
  modified_base (38)..(38): a, c, u, g, unknown or other
  modified_base (41)..(60): a, c, u, g, unknown or other
nnnnnnnnnnnnnnnnnnnnnnnnnnnnnnnnnnnccnggnnnnnnnnnnnnnnnnnnnn

SEQ ID NO: 82 - RNA, 60 nt, Artificial Sequence
  source: /note="Description of Artificial Sequence: Synthetic oligonucleotide"
  modified_base (1)..(21): a, c, u, g, unknown or other
  modified_base (26)..(60): a, c, u, g, unknown or other
nnnnnnnnnnnnnnnnnnnnnccggnnnnnnnnnnnnnnnnnnnnnnnnnnnnnnnnnnn

SEQ ID NO: 83 - RNA, 60 nt, Artificial Sequence
  source: /note="Description of Artificial Sequence: Synthetic oligonucleotide"
  modified_base (1)..(35): a, c, u, g, unknown or other
  modified_base (40)..(60): a, c, u, g, unknown or other
nnnnnnnnnnnnnnnnnnnnnnnnnnnnnnnnnnnccggnnnnnnnnnnnnnnnnnnnnn

SEQ ID NO: 84 - RNA, 60 nt, Artificial Sequence
  source: /note="Description of Artificial Sequence: Synthetic oligonucleotide"
  modified_base (1)..(23): a, c, u, g, unknown or other
  modified_base (26)..(60): a, c, u, g, unknown or other
nnnnnnnnnnnnnnnnnnnnnnnggnnnnnnnnnnnnnnnnnnnnnnnnnnnnnnnnnnn

SEQ ID NO: 85 - RNA, 60 nt, Artificial Sequence
  source: /note="Description of Artificial Sequence: Synthetic oligonucleotide"
  modified_base (1)..(33): a, c, u, g, unknown or other
  modified_base (38)..(60): a, c, u, g, unknown or other
nnnnnnnnnnnnnnnnnnnnnnnnnnnnnnnnnggccnnnnnnnnnnnnnnnnnnnnnnn

SEQ ID NO: 86 - RNA, 60 nt, Artificial Sequence
  source: /note="Description of Artificial Sequence: Synthetic oligonucleotide"
  modified_base (1)..(22): a, c, u, g, unknown or other
  modified_base (26)..(60): a, c, u, g, unknown or other
nnnnnnnnnnnnnnnnnnnnnncggnnnnnnnnnnnnnnnnnnnnnnnnnnnnnnnnnnn

SEQ ID NO: 87 - RNA, 60 nt, Artificial Sequence
  source: /note="Description of Artificial Sequence: Synthetic oligonucleotide"
  modified_base (1)..(32): a, c, u, g, unknown or other
  modified_base (35)..(35): a, c, u, g, unknown or other
  modified_base (38)..(60): a, c, u, g, unknown or other
nnnnnnnnnnnnnnnnnnnnnnnnnnnnnnnnggnccnnnnnnnnnnnnnnnnnnnnnnn

SEQ ID NO: 88 - RNA, 60 nt, Artificial Sequence
  source: /note="Description of Artificial Sequence: Synthetic oligonucleotide"
  modified_base (1)..(31): a, c, u, g, unknown or other
  modified_base (34)..(35): a, c, u, g, unknown or other
  modified_base (38)..(60): a, c, u, g, unknown or other
nnnnnnnnnnnnnnnnnnnnnnnnnnnnnnnggnnccnnnnnnnnnnnnnnnnnnnnnnn

SEQ ID NO: 89 - RNA, 60 nt, Artificial Sequence
  source: /note="Description of Artificial Sequence: Synthetic oligonucleotide"
  modified_base (1)..(30): a, c, u, g, unknown or other
  modified_base (33)..(35): a, c, u, g, unknown or other
  modified_base (38)..(60): a, c, u, g, unknown or other
nnnnnnnnnnnnnnnnnnnnnnnnnnnnnnggnnnccnnnnnnnnnnnnnnnnnnnnnnn

SEQ ID NO: 90 - RNA, 60 nt, Artificial Sequence
  source: /note="Description of Artificial Sequence: Synthetic oligonucleotide"
  modified_base (1)..(29): a, c, u, g, unknown or other
  modified_base (32)..(35): a, c, u, g, unknown or other
  modified_base (38)..(60): a, c, u, g, unknown or other
nnnnnnnnnnnnnnnnnnnnnnnnnnnnnggnnnnccnnnnnnnnnnnnnnnnnnnnnnn

SEQ ID NO: 91 - RNA, 60 nt, Artificial Sequence
  source: /note="Description of Artificial Sequence: Synthetic oligonucleotide"
  modified_base (1)..(28): a, c, u, g, unknown or other
  modified_base (31)..(35): a, c, u, g, unknown or other
  modified_base (38)..(60): a, c, u, g, unknown or other
nnnnnnnnnnnnnnnnnnnnnnnnnnnnggnnnnnccnnnnnnnnnnnnnnnnnnnnnnn

SEQ ID NO: 92 - RNA, 12 nt, Artificial Sequence
  source: /note="Description of Artificial Sequence: Synthetic oligonucleotide"
guuuuagagcua

SEQ ID NO: 93 - DNA, 23 bp, Artificial Sequence
  source: /note="Description of Artificial Sequence: Synthetic oligonucleotide"
taatacgactcactatagggaga

SEQ ID NO: 94 - DNA, 25 bp, Artificial Sequence
  source: /note="Description of Artificial Sequence: Synthetic oligonucleotide"
caccaaactctgcaagatcccagag

SEQ ID NO: 95 - DNA, 25 bp, Artificial Sequence
  source: /note="Description of Artificial Sequence: Synthetic oligonucleotide"
aaactctgcaagatcccagagtgag

SEQ ID NO: 96 - DNA, 25 bp, Artificial Sequence
  source: /note="Description of Artificial Sequence: Synthetic oligonucleotide"
actctgcaagatcccagagtgagag

SEQ ID NO: 97 - DNA, 25 bp, Artificial Sequence
  source: /note="Description of Artificial Sequence: Synthetic oligonucleotide"
ccctgctggtggctccagttcagga

SEQ ID NO: 98 - DNA, 25 bp, Artificial Sequence
  source: /note="Description of Artificial Sequence: Synthetic oligonucleotide"
cctgctggtggctccagttcaggag

SEQ ID NO: 99 - DNA, 25 bp, Artificial Sequence
  source: /note="Description of Artificial Sequence: Synthetic oligonucleotide"
ctcccttatcgtcaatcttctcgag

SEQ ID NO: 100 - DNA, 25 bp, Artificial Sequence
  source: /note="Description of Artificial Sequence: Synthetic oligonucleotide"
cccttatcgtcaatcttctcgagga

SEQ ID NO: 101 - DNA, 25 bp, Artificial Sequence
  source: /note="Description of Artificial Sequence: Synthetic oligonucleotide"
atcgtcaatcttctcgaggattggg

SEQ ID NO: 102 - DNA, 25 bp, Artificial Sequence
  source: /note="Description of Artificial Sequence: Synthetic oligonucleotide"
tcgtcaatcttctcgaggattgggg

SEQ ID NO: 103 - DNA, 25 bp, Artificial Sequence
  source: /note="Description of Artificial Sequence: Synthetic oligonucleotide"
cgtcaatcttctcgaggattgggga

SEQ ID NO: 104 - DNA, 25 bp, Artificial Sequence
  source: /note="Description of Artificial Sequence: Synthetic oligonucleotide"
cgaggattggggaccctgcgctgaa

SEQ ID NO: 105 - DNA, 25 bp, Artificial Sequence
  source: /note="Description of Artificial Sequence: Synthetic oligonucleotide"
ttggggaccctgcgctgaacatgga

SEQ ID NO: 106 - DNA, 25 bp, Artificial Sequence
  source: /note="Description of Artificial Sequence: Synthetic oligonucleotide"
tggggaccctgcgctgaacatggag

SEQ ID NO: 107 - DNA, 25 bp, Artificial Sequence
  source: /note="Description of Artificial Sequence: Synthetic oligonucleotide"
gggaccctgcgctgaacatggagaa

SEQ ID NO: 108 - DNA, 25 bp, Artificial Sequence
  source: /note="Description of Artificial Sequence: Synthetic oligonucleotide"
gaacatggagaacatcacatcagga

SEQ ID NO: 109 - DNA, 25 bp, Artificial Sequence
  source: /note="Description of Artificial Sequence: Synthetic oligonucleotide"
gaacatcacatcaggattcctagga

SEQ ID NO: 110 - DNA, 25 bp, Artificial Sequence
  source: /note="Description of Artificial Sequence: Synthetic oligonucleotide"
gaccccttctcgtgttacaggcggg

SEQ ID NO: 111 - DNA, 25 bp, Artificial Sequence
  source: /note="Description of Artificial Sequence: Synthetic oligonucleotide"
accccttctcgtgttacaggcgggg

SEQ ID NO: 112 - DNA, 25 bp, Artificial Sequence
  source: /note="Description of Artificial Sequence: Synthetic oligonucleotide"
gcggggtttttcttgttgacaagaa

SEQ ID NO: 113 - DNA, 25 bp, Artificial Sequence
  source: /note="Description of Artificial Sequence: Synthetic oligonucleotide"
caagaatcctcacaataccgcagag

SEQ ID NO: 114 - DNA, 25 bp, Artificial Sequence
  source: /note="Description of Artificial Sequence: Synthetic oligonucleotide"
ccgcagagtctagactcgtggtgga

SEQ ID NO: 115 - DNA, 25 bp, Artificial Sequence
  source: /note="Description of Artificial Sequence: Synthetic oligonucleotide"
gtggacttctctcaattttctaggg

SEQ ID NO: 116 - DNA, 25 bp, Artificial Sequence
  source: /note="Description of Artificial Sequence: Synthetic oligonucleotide"
tggacttctctcaattttctagggg

SEQ ID NO: 117 - DNA, 25 bp, Artificial Sequence
  source: /note="Description of Artificial Sequence: Synthetic oligonucleotide"
ggacttctctcaattttctaggggg

SEQ ID NO: 118 - DNA, 25 bp, Artificial Sequence
  source: /note="Description of Artificial Sequence: Synthetic oligonucleotide"
gacttctctcaattttctaggggga

SEQ ID NO: 119 - DNA, 25 bp, Artificial Sequence
  source: /note="Description of Artificial Sequence: Synthetic oligonucleotide"
acttctctcaattttctagggggaa

SEQ ID NO: 120 - DNA, 25 bp, Artificial Sequence
  source: /note="Description of Artificial Sequence: Synthetic oligonucleotide"
ccaacttgtcctggttatcgctgga

SEQ ID NO: 121 - DNA, 25 bp, Artificial Sequence
  source: /note="Description of Artificial Sequence: Synthetic oligonucleotide"
tcatcttcttgttggttcttctgga

SEQ ID NO: 122 - DNA, 25 bp, Artificial Sequence
  source: /note="Description of Artificial Sequence: Synthetic oligonucleotide"
gcccgtttgtcctctaattccagga

SEQ ID NO: 123 - DNA, 25 bp, Artificial Sequence
  source: /note="Description of Artificial Sequence: Synthetic oligonucleotide"
caggatcctcaaccaccagcacggg

SEQ ID NO: 124 - DNA, 25 bp, Artificial Sequence
  source: /note="Description of Artificial Sequence: Synthetic oligonucleotide"
aggatcctcaaccaccagcacggga

SEQ ID NO: 125 - DNA, 25 bp, Artificial Sequence
  source: /note="Description of Artificial Sequence: Synthetic oligonucleotide"
accaccagcacgggaccatgccgaa

SEQ ID NO: 126 - DNA, 25 bp, Artificial Sequence
  source: /note="Description of Artificial Sequence: Synthetic oligonucleotide"
aacctgcatgactactgctcaagga

SEQ ID NO: 127 - DNA, 25 bp, Artificial Sequence
  source: /note="Description of Artificial Sequence: Synthetic oligonucleotide"
acctgcatgactactgctcaaggaa

SEQ ID NO: 128 - DNA, 25 bp, Artificial Sequence
  source: /note="Description of Artificial Sequence: Synthetic oligonucleotide"
cctgttgctgtaccaaaccttcgga

SEQ ID NO: 129 - DNA, 25 bp, Artificial Sequence
  source: /note="Description of Artificial Sequence: Synthetic oligonucleotide"
ttgctgtaccaaaccttcggacgga

SEQ ID NO: 130 - DNA, 25 bp, Artificial Sequence
  source: /note="Description of Artificial Sequence: Synthetic oligonucleotide"
tgctgtaccaaaccttcggacggaa

SEQ ID NO: 131 - DNA, 25 bp, Artificial Sequence
  source: /note="Description of Artificial Sequence: Synthetic oligonucleotide"
tgtattcccatcccatcatcctggg

SEQ ID NO: 132 - DNA, 25 bp, Artificial Sequence
  source: /note="Description of Artificial Sequence: Synthetic oligonucleotide"
catcccatcatcctgggctttcgga

SEQ ID NO: 133 - DNA, 25 bp, Artificial Sequence
  source: /note="Description of Artificial Sequence: Synthetic oligonucleotide"
atcccatcatcctgggctttcggaa

SEQ ID NO: 134 - DNA, 25 bp, Artificial Sequence
  source: /note="Description of Artificial Sequence: Synthetic oligonucleotide"
tgggctttcggaaaattcctatggg

SEQ ID NO: 135 - DNA, 25 bp, Artificial Sequence
  source: /note="Description of Artificial Sequence: Synthetic oligonucleotide"
gggctttcggaaaattcctatggga

SEQ ID NO: 136 - DNA, 25 bp, Artificial Sequence
  source: /note="Description of Artificial Sequence: Synthetic oligonucleotide"
ggctttcggaaaattcctatgggag

SEQ ID NO: 137 - DNA, 25 bp, Artificial Sequence
  source: /note="Description of Artificial Sequence: Synthetic oligonucleotide"
ttcggaaaattcctatgggagtggg

SEQ ID NO: 138 - DNA, 25 bp, Artificial Sequence
  source: /note="Description of Artificial Sequence: Synthetic oligonucleotide"
gccatttgttcagtggttcgtaggg

SEQ ID NO: 139 - DNA, 25 bp, Artificial Sequence
  source: /note="Description of Artificial Sequence: Synthetic oligonucleotide"
actgtttggctttcagttatatgga

SEQ ID NO: 140 - DNA, 25 bp, Artificial Sequence
  source: /note="Description of Artificial Sequence: Synthetic oligonucleotide"
gttatatggatgatgtggtattggg

SEQ ID NO: 141 - DNA, 25 bp, Artificial Sequence
  source: /note="Description of Artificial Sequence: Synthetic oligonucleotide"
ttatatggatgatgtggtattgggg

SEQ ID NO: 142 - DNA, 25 bp, Artificial Sequence
  source: /note="Description of Artificial Sequence: Synthetic oligonucleotide"
tatatggatgatgtggtattggggg

SEQ ID NO: 143 - DNA, 25 bp, Artificial Sequence
  source: /note="Description of Artificial Sequence: Synthetic oligonucleotide"
ggccaagtctgtacagcatcttgag

SEQ ID NO: 144 - DNA, 25 bp, Artificial Sequence
  source: /note="Description of Artificial Sequence: Synthetic oligonucleotide"
ttaccaattttcttttgtctttggg

SEQ ID NO: 145 - DNA, 25 bp, Artificial Sequence
  source: /note="Description of Artificial Sequence: Synthetic oligonucleotide"
atttaaaccctaacaaaacaaagag

SEQ ID NO: 146 - DNA, 25 bp, Artificial Sequence
  source: /note="Description of Artificial Sequence: Synthetic oligonucleotide"
aaccctaacaaaacaaagagatggg

SEQ ID NO: 147 - DNA, 25 bp, Artificial Sequence
  source: /note="Description of Artificial Sequence: Synthetic oligonucleotide"
accctaacaaaacaaagagatgggg

SEQ ID NO: 148 - DNA, 25 bp, Artificial Sequence
  source: /note="Description of Artificial Sequence: Synthetic oligonucleotide"
caaagagatggggttactctctgaa

SEQ ID NO: 149 - DNA, 25 bp, Artificial Sequence
  source: /note="Description of Artificial Sequence: Synthetic oligonucleotide"
ggggttactctctgaattttatggg

SEQ ID NO: 150 - DNA, 25 bp, Artificial Sequence
  source: /note="Description of Artificial Sequence: Synthetic oligonucleotide"
gaattttatgggttatgtcattgga

SEQ ID NO: 151 - DNA, 25 bp, Artificial Sequence
  source: /note="Description of Artificial Sequence: Synthetic oligonucleotide"
aattttatgggttatgtcattggaa

SEQ ID NO: 152 - DNA, 25 bp, Artificial Sequence
  source: /note="Description of Artificial Sequence: Synthetic oligonucleotide"
gggttatgtcattggaagttatggg

SEQ ID NO: 153 - DNA, 25 bp, Artificial Sequence
  source: /note="Description of Artificial Sequence: Synthetic oligonucleotide"
aagttatgggtccttgccacaagaa

SEQ ID NO: 154 - DNA, 25 bp, Artificial Sequence
  source: /note="Description of Artificial Sequence: Synthetic oligonucleotide"
acacatcatacaaaaaatcaaagaa

SEQ ID NO: 155 - DNA, 25 bp, Artificial Sequence
  source: /note="Description of Artificial Sequence: Synthetic oligonucleotide"
caaaaaatcaaagaatgttttagaa

SEQ ID NO: 156 - DNA, 25 bp, Artificial Sequence
  source: /note="Description of Artificial Sequence: Synthetic oligonucleotide"
cctattaacaggcctattgattgga

SEQ ID NO: 157 - DNA, 25 bp, Artificial Sequence
  source: /note="Description of Artificial Sequence: Synthetic oligonucleotide"
ctattaacaggcctattgattggaa

SEQ ID NO: 158 - DNA, 25 bp, Artificial Sequence
  source: /note="Description of Artificial Sequence: Synthetic oligonucleotide"
attgattggaaagtatgtcaacgaa

SEQ ID NO: 159 - DNA, 25 bp, Artificial Sequence
  source: /note="Description of Artificial Sequence: Synthetic oligonucleotide"
ggaaagtatgtcaacgaattgtggg

SEQ ID NO: 160 - DNA, 25 bp, Artificial Sequence
  source: /note="Description of Artificial Sequence: Synthetic oligonucleotide"
gtcaacgaattgtgggtcttttggg

SEQ ID NO: 161 - DNA, 25 bp, Artificial Sequence
  source: /note="Description of Artificial Sequence: Synthetic oligonucleotide"
cctttctgtgtaaacaatacctgaa

SEQ ID NO: 162 - DNA, 25 bp, Artificial Sequence
  source: /note="Description of Artificial Sequence: Synthetic oligonucleotide"
gctgacgcaacccccactggctggg

SEQ ID NO: 163 - DNA, 25 bp, Artificial Sequence
  source: /note="Description of Artificial Sequence: Synthetic oligonucleotide"
ctgacgcaacccccactggctgggg

SEQ ID NO: 164 - DNA, 25 bp, Artificial Sequence
  source: /note="Description of Artificial Sequence: Synthetic oligonucleotide"
ccactggctggggcttggtcatggg

SEQ ID NO: 165 - DNA, 25 bp, Artificial Sequence
  source: /note="Description of Artificial Sequence: Synthetic oligonucleotide"
catgggccatcagcgcgtgcgtgga

SEQ ID NO: 166 - DNA, 25 bp, Artificial Sequence
  source: /note="Description of Artificial Sequence: Synthetic oligonucleotide"
atgggccatcagcgcgtgcgtggaa

SEQ ID NO: 167 - DNA, 25 bp, Artificial Sequence
  source: /note="Description of Artificial Sequence: Synthetic oligonucleotide"
ctcctctgccgatccatactgcgga

SEQ ID NO: 168 - DNA, 25 bp, Artificial Sequence
  source: /note="Description of Artificial Sequence: Synthetic oligonucleotide"
tcctctgccgatccatactgcggaa

SEQ ID NO: 169 - DNA, 25 bp, Artificial Sequence
  source: /note="Description of Artificial Sequence: Synthetic oligonucleotide"
ttgttttgctcgcagcaggtctgga

SEQ ID NO: 170 - DNA, 25 bp, Artificial Sequence
  source: /note="Description of Artificial Sequence: Synthetic oligonucleotide"
tgttttgctcgcagcaggtctggag

SEQ ID NO: 171 - DNA, 25 bp, Artificial Sequence
  source: /note="Description of Artificial Sequence: Synthetic oligonucleotide"
caggtctggagcaaacattatcggg

SEQ ID NO: 172 - DNA, 25 bp, Artificial Sequence
  source: /note="Description of Artificial Sequence: Synthetic oligonucleotide"
aggtctggagcaaacattatcggga

SEQ ID NO: 173 - DNA, 25 bp, Artificial Sequence
  source: /note="Description of Artificial Sequence: Synthetic oligonucleotide"
ctgctaggctgtgctgccaactgga

SEQ ID NO: 174 - DNA, 25 bp, Artificial Sequence
  source: /note="Description of Artificial Sequence: Synthetic oligonucleotide"
tgctgccaactggatcctgcgcggg

SEQ ID NO: 175 - DNA, 25 bp, Artificial Sequence
  source: /note="Description of Artificial Sequence: Synthetic oligonucleotide"
gctgccaactggatcctgcgcggga

SEQ ID NO: 176 - DNA, 25 bp, Artificial Sequence
  source: /note="Description of Artificial Sequence: Synthetic oligonucleotide"
ttgtttacgtcccgtcggcgctgaa

SEQ ID NO: 177 - DNA, 25 bp, Artificial Sequence
  source: /note="Description of Artificial Sequence: Synthetic oligonucleotide"
tcccgtcggcgctgaatcctgcgga

SEQ ID NO: 178 - DNA, 25 bp, Artificial Sequence
  source: /note="Description of Artificial Sequence: Synthetic oligonucleotide"
aatcctgcggacgacccttctcggg

SEQ ID NO: 179 - DNA, 25 bp, Artificial Sequence
  source: /note="Description of Artificial Sequence: Synthetic oligonucleotide"
atcctgcggacgacccttctcgggg

SEQ ID NO: 180 - DNA, 25 bp, Artificial Sequence
  source: /note="Description of Artificial Sequence: Synthetic oligonucleotide"
acgacccttctcggggtcgcttggg

SEQ ID NO: 181 - DNA, 25 bp, Artificial Sequence
  source: /note="Description of Artificial Sequence: Synthetic oligonucleotide"
cgacccttctcggggtcgcttggga

SEQ ID NO: 182 - DNA, 25 bp, Artificial Sequence
  source: /note="Description of Artificial Sequence: Synthetic oligonucleotide"
gtctgccgttccgaccgaccacggg

SEQ ID NO: 183 - DNA, 25 bp, Artificial Sequence
  source: /note="Description of Artificial Sequence: Synthetic oligonucleotide"
tctgccgttccgaccgaccacgggg

SEQ ID NO: 184 - DNA, 25 bp, Artificial Sequence
  source: /note="Description of Artificial Sequence: Synthetic oligonucleotide"
cggggcgcacctctctttacgcgga

SEQ ID NO: 185 - DNA, 25 bp, Artificial Sequence
  source: /note="Description of Artificial Sequence: Synthetic oligonucleotide"
cgtctgtgccttctcatctgccgga

SEQ ID NO: 186 - DNA, 25 bp, Artificial Sequence
  source: /note="Description of Artificial Sequence: Synthetic oligonucleotide"
gcttcacctctgcacgtcgcatgga

SEQ ID NO: 187 - DNA, 25 bp, Artificial Sequence
  source: /note="Description of Artificial Sequence: Synthetic oligonucleotide"
cttcacctctgcacgtcgcatggag

SEQ ID NO: 188 - DNA, 25 bp, Artificial Sequence
  source: /note="Description of Artificial Sequence: Synthetic oligonucleotide"
cacgtcgcatggagaccaccgtgaa

SEQ ID NO: 189 - DNA, 25 bp, Artificial Sequence
  source: /note="Description of Artificial Sequence: Synthetic oligonucleotide"
gagaccaccgtgaacgcccaccgaa

SEQ ID NO: 190 - DNA, 25 bp, Artificial Sequence
  source: /note="Description of Artificial Sequence: Synthetic oligonucleotide"
tgttgcccaaggtcttacataagag

SEQ ID NO: 191 - DNA, 25 bp, Artificial Sequence
  source: /note="Description of Artificial Sequence: Synthetic oligonucleotide"
ttgcccaaggtcttacataagagga

SEQ ID NO: 192 - DNA, 25 bp, Artificial Sequence
  source: /note="Description of Artificial Sequence: Synthetic oligonucleotide"
ggtcttacataagaggactcttgga

SEQ ID NO: 193 - DNA, 25 bp, Artificial Sequence
  source: /note="Description of Artificial Sequence: Synthetic oligonucleotide"
tgcaatgtcaacgaccgaccttgag

SEQ ID NO: 194 - DNA, 25 bp, Artificial Sequence
  source: /note="Description of Artificial Sequence: Synthetic oligonucleotide"
aaagactgtttgtttaaagactggg

SEQ ID NO: 195 - DNA, 25 bp, Artificial Sequence
  source: /note="Description of Artificial Sequence: Synthetic oligonucleotide"
aagactgtttgtttaaagactggga

SEQ ID NO: 196 - DNA, 25 bp, Artificial Sequence
  source: /note="Description of Artificial Sequence: Synthetic oligonucleotide"
agactgtttgtttaaagactgggag

SEQ ID NO: 197 - DNA, 25 bp, Artificial Sequence
  source: /note="Description of Artificial Sequence: Synthetic oligonucleotide"
actgtttgtttaaagactgggagga

SEQ ID NO: 198 - DNA, 25 bp, Artificial Sequence
  source: /note="Description of Artificial Sequence: Synthetic oligonucleotide"
ctgtttgtttaaagactgggaggag

SEQ ID NO: 199 - DNA, 25 bp, Artificial Sequence
  source: /note="Description of Artificial Sequence: Synthetic oligonucleotide"
tgtttaaagactgggaggagttggg

SEQ ID NO: 200 - DNA, 25 bp, Artificial Sequence
  source: /note="Description of Artificial Sequence: Synthetic oligonucleotide"
gtttaaagactgggaggagttgggg

SEQ ID NO: 201 - DNA, 25 bp, Artificial Sequence
  source: /note="Description of Artificial Sequence: Synthetic oligonucleotide"
tttaaagactgggaggagttggggg

SEQ ID NO: 202 - DNA, 25 bp, Artificial Sequence
  source: /note="Description of Artificial Sequence: Synthetic oligonucleotide"
ttaaagactgggaggagttggggga

SEQ ID NO: 203 - DNA, 25 bp, Artificial Sequence
  source: /note="Description of Artificial Sequence: Synthetic oligonucleotide"
taaagactgggaggagttgggggag

SEQ ID NO: 204 - DNA, 25 bp, Artificial Sequence
  source: /note="Description of Artificial Sequence: Synthetic oligonucleotide"
aagactgggaggagttgggggagga

SEQ ID NO: 205 - DNA, 25 bp, Artificial Sequence
  source: /note="Description of Artificial Sequence: Synthetic oligonucleotide"
agactgggaggagttgggggaggag

SEQ ID NO: 206 - DNA, 25 bp, Artificial Sequence
  source: /note="Description of Artificial Sequence: Synthetic oligonucleotide"
tagattaaaggtctttgtactagga

SEQ ID NO: 207 - DNA, 25 bp, Artificial Sequence
  source: /note="Description of Artificial Sequence: Synthetic oligonucleotide"
agattaaaggtctttgtactaggag

SEQ ID NO: 208 - DNA, 25 bp, Artificial Sequence
  source: /note="Description of Artificial Sequence: Synthetic oligonucleotide"
tcaagcctccaagctgtgccttggg

SEQ ID NO: 209 - DNA, 25 bp, Artificial Sequence
  source: /note="Description of Artificial Sequence: Synthetic oligonucleotide"
aagctgtgccttgggtggctttggg

SEQ ID NO: 210 - DNA, 25 bp, Artificial Sequence
  source: /note="Description of Artificial Sequence: Synthetic oligonucleotide"
agctgtgccttgggtggctttgggg

SEQ ID NO: 211 - DNA, 25 bp, Artificial Sequence
  source: /note="Description of Artificial Sequence: Synthetic oligonucleotide"
gccttgggtggctttggggcatgga

SEQ ID NO: 212 - DNA, 25 bp, Artificial Sequence
  source: /note="Description of Artificial Sequence: Synthetic oligonucleotide"
catggacatcgacccttataaagaa

SEQ ID NO: 213 - DNA, 25 bp, Artificial Sequence
  source: /note="Description of Artificial Sequence: Synthetic oligonucleotide"
catcgacccttataaagaatttgga

SEQ ID NO: 214 - DNA, 25 bp, Artificial Sequence
  source: /note="Description of Artificial Sequence: Synthetic oligonucleotide"
atcgacccttataaagaatttggag

SEQ ID NO: 215 - DNA, 25 bp, Artificial Sequence
  source: /note="Description of Artificial Sequence: Synthetic oligonucleotide"
ataaagaatttggagctactgtgga

SEQ ID NO: 216 - DNA, 25 bp, Artificial Sequence
  source: /note="Description of Artificial Sequence: Synthetic oligonucleotide"
taaagaatttggagctactgtggag

SEQ ID NO: 217 - DNA, 25 bp, Artificial Sequence
  source: /note="Description of Artificial Sequence: Synthetic oligonucleotide"
tctgacttctttccttcagtacgag

SEQ ID NO: 218 - DNA, 25 bp, Artificial Sequence
  source: /note="Description of Artificial Sequence: Synthetic oligonucleotide"
gataccgcctcagctctgtatcggg

SEQ ID NO: 219 - DNA, 25 bp, Artificial Sequence
  source: /note="Description of Artificial Sequence: Synthetic oligonucleotide"
ataccgcctcagctctgtatcggga

SEQ ID NO: 220 - DNA, 25 bp, Artificial Sequence
  source: /note="Description of Artificial Sequence: Synthetic oligonucleotide"
taccgcctcagctctgtatcgggaa

SEQ ID NO: 221 - DNA, 25 bp, Artificial Sequence
  source: /note="Description of Artificial Sequence: Synthetic oligonucleotide"
agctctgtatcgggaagccttagag

SEQ ID NO: 222 - DNA, 25 bp, Artificial Sequence
  source: /note="Description of Artificial Sequence: Synthetic oligonucleotide"
tcgggaagccttagagtctcctgag

SEQ ID NO: 223 - DNA, 25 bp, Artificial Sequence
  source: /note="Description of Artificial Sequence: Synthetic oligonucleotide"
ctcaggcaagcaattctttgctggg

SEQ ID NO: 224 - DNA, 25 bp, Artificial Sequence
  source: /note="Description of Artificial Sequence: Synthetic oligonucleotide"
tcaggcaagcaattctttgctgggg

SEQ ID NO: 225 - DNA, 25 bp, Artificial Sequence
  source: /note="Description of Artificial Sequence: Synthetic oligonucleotide"
caggcaagcaattctttgctggggg

SEQ ID NO: 226 - DNA, 25 bp, Artificial Sequence
  source: /note="Description of Artificial Sequence: Synthetic oligonucleotide"
aggcaagcaattctttgctgggggg

SEQ ID NO: 227 - DNA, 25 bp, Artificial Sequence
  source: /note="Description of Artificial Sequence: Synthetic oligonucleotide"
ggcaagcaattctttgctgggggga

SEQ ID NO: 228 - DNA, 25 bp, Artificial Sequence
  source: /note="Description of Artificial Sequence: Synthetic oligonucleotide"
gcaagcaattctttgctggggggaa

SEQ ID NO: 229 - DNA, 25 bp, Artificial Sequence
  source: /note="Description of Artificial Sequence: Synthetic oligonucleotide"
gaactaatgactctagctacctggg

SEQ ID NO: 230 - DNA, 25 bp, Artificial Sequence
  source: /note="Description of Artificial Sequence: Synthetic oligonucleotide"
taatgactctagctacctgggtggg

SEQ ID NO: 231 - DNA, 25 bp, Artificial Sequence
  source: /note="Description of Artificial Sequence: Synthetic oligonucleotide"
ctacctgggtgggtgttaatttgga

SEQ ID NO: 232 - DNA, 25 bp, Artificial Sequence
  source: /note="Description of Artificial Sequence: Synthetic oligonucleotide"
tacctgggtgggtgttaatttggaa

SEQ ID NO: 233 - DNA, 25 bp, Artificial Sequence
  source: /note="Description of Artificial Sequence: Synthetic oligonucleotide"
aatttggaagatccagcatctagag

SEQ ID NO: 234 - DNA, 25 bp, Artificial Sequence
  source: /note="Description of Artificial Sequence: Synthetic oligonucleotide"
tcagttatgtcaacactaatatggg

SEQ ID NO: 235 - DNA, 25 bp, Artificial Sequence
  source: /note="Description of Artificial Sequence: Synthetic oligonucleotide"
tcacatttcttgtctcacttttgga

SEQ ID NO: 236 - DNA, 25 bp, Artificial Sequence
  source: /note="Description of Artificial Sequence: Synthetic oligonucleotide"
cacatttcttgtctcacttttggaa

SEQ ID NO: 237 - DNA, 25 bp, Artificial Sequence
  source: /note="Description of Artificial Sequence: Synthetic oligonucleotide"
atttcttgtctcacttttggaagag

SEQ ID NO: 238 - DNA, 25 bp, Artificial Sequence
  source: /note="Description of Artificial Sequence: Synthetic oligonucleotide"
ttcttgtctcacttttggaagagaa

SEQ ID NO: 239 - DNA, 25 bp, Artificial Sequence
  source: /note="Description of Artificial Sequence: Synthetic oligonucleotide"
ttttggaagagaaaccgttatagag

SEQ ID NO: 240 - DNA, 25 bp, Artificial Sequence
  source: /note="Description of Artificial Sequence: Synthetic oligonucleotide"
tatagagtatttggtgtctttcgga

SEQ ID NO: 241 - DNA, 25 bp, Artificial Sequence
  source: /note="Description of Artificial Sequence: Synthetic oligonucleotide"
atagagtatttggtgtctttcggag

SEQ ID NO: 242 - DNA, 25 bp, Artificial Sequence
  source: /note="Description of Artificial Sequence: Synthetic oligonucleotide"
tatttggtgtctttcggagtgtgga

SEQ ID NO: 243 - DNA, 25 bp, Artificial Sequence
  source: /note="Description of Artificial Sequence: Synthetic oligonucleotide"
cccctatcctatcaacacttccgga

SEQ ID NO: 244 - DNA, 25 bp, Artificial Sequence
  source: /note="Description of Artificial Sequence: Synthetic oligonucleotide"
ccctatcctatcaacacttccggaa

SEQ ID NO: 245 - DNA, 25 bp, Artificial Sequence
  source: /note="Description of Artificial Sequence: Synthetic oligonucleotide"
gaaactactgttgttagacgacgag

SEQ ID NO: 246 - DNA, 25 bp, Artificial Sequence
  source: /note="Description of Artificial Sequence: Synthetic oligonucleotide"
agacgacgaggcaggtcccctagaa

SEQ ID NO: 247 - DNA, 25 bp, Artificial Sequence
  source: /note="Description of Artificial Sequence: Synthetic oligonucleotide"
cgacgaggcaggtcccctagaagaa

SEQ ID NO: 248 - DNA, 25 bp, Artificial Sequence
  source: /note="Description of Artificial Sequence: Synthetic oligonucleotide"
cgaggcaggtcccctagaagaagaa

SEQ ID NO: 249 - DNA, 25 bp, Artificial Sequence
  source: /note="Description of Artificial Sequence: Synthetic oligonucleotide"
agaactccctcgcctcgcagacgaa

SEQ ID NO: 250 - DNA, 25 bp, Artificial Sequence
  source: /note="Description of Artificial Sequence: Synthetic oligonucleotide"
aggtctcaatcgccgcgtcgcagaa

SEQ ID NO: 251 - DNA, 25 bp, Artificial Sequence
  source: /note="Description of Artificial Sequence: Synthetic oligonucleotide"
cgtcgcagaagatctcaatctcggg

SEQ ID NO: 252 - DNA, 25 bp, Artificial Sequence
  source: /note="Description of Artificial Sequence: Synthetic oligonucleotide"
gtcgcagaagatctcaatctcggga

SEQ ID NO: 253 - DNA, 25 bp, Artificial Sequence
  source: /note="Description of Artificial Sequence: Synthetic oligonucleotide"
tcgcagaagatctcaatctcgggaa

SEQ ID NO: 254 - DNA, 25 bp, Artificial Sequence
  source: /note="Description of Artificial Sequence: Synthetic oligonucleotide"
aacctcaatgttagtattccttgga

SEQ ID NO: 255 - DNA, 25 bp, Artificial Sequence
  source: /note="Description of Artificial Sequence: Synthetic oligonucleotide"
gtattccttggactcataaggtggg

SEQ ID NO: 256 - DNA, 25 bp, Artificial Sequence
  source: /note="Description of Artificial Sequence: Synthetic oligonucleotide"
tattccttggactcataaggtgggg

SEQ ID NO: 257 - DNA, 25 bp, Artificial Sequence
  source: /note="Description of Artificial Sequence: Synthetic oligonucleotide"
attccttggactcataaggtgggga

SEQ ID NO: 258 - DNA, 25 bp, Artificial Sequence
  source: /note="Description of Artificial Sequence: Synthetic oligonucleotide"
ttccttggactcataaggtggggaa

SEQ ID NO: 259 - DNA, 25 bp, Artificial Sequence
  source: /note="Description of Artificial Sequence: Synthetic oligonucleotide"
gtacctgtctttaatcctcattgga

SEQ ID NO: 260 - DNA, 25 bp, Artificial Sequence
  source: /note="Description of Artificial Sequence: Synthetic oligonucleotide"
tacctgtctttaatcctcattggaa

SEQ ID NO: 261 - DNA, 25 bp, Artificial Sequence
  source: /note="Description of Artificial Sequence: Synthetic oligonucleotide"
ccaagacattatcaaaaaatgtgaa

SEQ ID NO: 262 - DNA, 25 bp, Artificial Sequence
  source: /note="Description of Artificial Sequence: Synthetic oligonucleotide"
tgtaggcccacttacagttaatgag

SEQ ID NO: 263 - DNA, 25 bp, Artificial Sequence
  source: /note="Description of Artificial Sequence: Synthetic oligonucleotide"
taggcccacttacagttaatgagaa

SEQ ID NO: 264 - DNA, 25 bp, Artificial Sequence
  source: /note="Description of Artificial Sequence: Synthetic oligonucleotide"
ccacttacagttaatgagaaaagaa

SEQ ID NO: 265 - DNA, 25 bp, Artificial Sequence
  source: /note="Description of Artificial Sequence: Synthetic oligonucleotide"
aggttaccaaatatttaccattgga

SEQ ID NO: 266 - DNA, 25 bp, Artificial Sequence
  source: /note="Description of Artificial Sequence: Synthetic oligonucleotide"
ccaaatatttaccattggataaggg

SEQ ID NO: 267 - DNA, 25 bp, Artificial Sequence
  source: /note="Description of Artificial Sequence: Synthetic oligonucleotide"
gggtattaaaccttattatccagaa

SEQ ID NO: 268 - DNA, 25 bp, Artificial Sequence
  source: /note="Description of Artificial Sequence: Synthetic oligonucleotide"
agacactatttacacactctatgga

SEQ ID NO: 269 - DNA, 25 bp, Artificial Sequence
  source: /note="Description of Artificial Sequence: Synthetic oligonucleotide"
gacactatttacacactctatggaa

SEQ ID NO: 270 - DNA, 25 bp, Artificial Sequence
  source: /note="Description of Artificial Sequence: Synthetic oligonucleotide"
atttacacactctatggaaggcggg

SEQ ID NO: 271 - DNA, 25 bp, Artificial Sequence
  source: /note="Description of Artificial Sequence: Synthetic oligonucleotide"
ggaaggcgggtatattatataagag

SEQ ID NO: 272 - DNA, 25 bp, Artificial Sequence
  source: /note="Description of Artificial Sequence: Synthetic oligonucleotide"
aaggcgggtatattatataagagag

SEQ ID NO: 273 - DNA, 25 bp, Artificial Sequence
  source: /note="Description of Artificial Sequence: Synthetic oligonucleotide"
ggcgggtatattatataagagagaa

SEQ ID NO: 274 - DNA, 25 bp, Artificial Sequence
  source: /note="Description of Artificial Sequence: Synthetic oligonucleotide"
aacacatagcgcctcattttgtggg

SEQ ID NO: 275 - DNA, 25 bp, Artificial Sequence
  source: /note="Description of Artificial Sequence: Synthetic oligonucleotide"
ttttgtgggtcaccatattcttggg

SEQ ID NO: 276 - DNA, 25 bp, Artificial Sequence
  source: /note="Description of Artificial Sequence: Synthetic oligonucleotide"
tttgtgggtcaccatattcttggga

SEQ ID NO: 277 - DNA, 25 bp, Artificial Sequence
  source: /note="Description of Artificial Sequence: Synthetic oligonucleotide"
ttgtgggtcaccatattcttgggaa

SEQ ID NO: 278 - DNA, 25 bp, Artificial Sequence
  source: /note="Description of Artificial Sequence: Synthetic oligonucleotide"
ttgggaacaagatctacagcatggg

SEQ ID NO: 279 - DNA, 25 bp, Artificial Sequence
  source: /note="Description of Artificial Sequence: Synthetic oligonucleotide"
tgggaacaagatctacagcatgggg

SEQ ID NO: 280 - DNA, 25 bp, Artificial Sequence
  source: /note="Description of Artificial Sequence: Synthetic oligonucleotide"
acaagatctacagcatggggcagaa

SEQ ID NO: 281 - DNA, 25 bp, Artificial Sequence
  source: /note="Description of Artificial Sequence: Synthetic oligonucleotide"
atctttccaccagcaatcctctggg

SEQ ID NO: 282 - DNA, 25 bp, Artificial Sequence
  source: /note="Description of Artificial Sequence: Synthetic oligonucleotide"
tctttccaccagcaatcctctggga

SEQ ID NO: 283 - DNA, 25 bp, Artificial Sequence
  source: /note="Description of Artificial Sequence: Synthetic oligonucleotide"
gattctttcccgaccaccagttgga

SEQ ID NO: 284 - DNA, 25 bp, Artificial Sequence
  source: /note="Description of Artificial Sequence: Synthetic oligonucleotide"
caccagttggatccagccttcagag

SEQ ID NO: 285 - DNA, 25 bp, Artificial Sequence
  source: /note="Description of Artificial Sequence: Synthetic oligonucleotide"
gcaaacacagcaaatccagattggg

SEQ ID NO: 286 - DNA, 25 bp, Artificial Sequence
  source: /note="Description of Artificial Sequence: Synthetic oligonucleotide"
caaacacagcaaatccagattggga

SEQ ID NO: 287 - DNA, 25 bp, Artificial Sequence
  source: /note="Description of Artificial Sequence: Synthetic oligonucleotide"
attgggacttcaatcccaacaagga

SEQ ID NO: 288 - DNA, 25 bp, Artificial Sequence
  source: /note="Description of Artificial Sequence: Synthetic oligonucleotide"
ctggccagacgccaacaaggtagga

SEQ ID NO: 289 - DNA, 25 bp, Artificial Sequence
  source: /note="Description of Artificial Sequence: Synthetic oligonucleotide"
tggccagacgccaacaaggtaggag

SEQ ID NO: 290 - DNA, 25 bp, Artificial Sequence
  source: /note="Description of Artificial Sequence: Synthetic oligonucleotide"
agacgccaacaaggtaggagctgga

SEQ ID NO: 291 - DNA, 25 bp, Artificial Sequence
  source: /note="Description of Artificial Sequence: Synthetic oligonucleotide"
gacgccaacaaggtaggagctggag

SEQ ID NO: 292 - DNA, 25 bp, Artificial Sequence
  source: /note="Description of Artificial Sequence: Synthetic oligonucleotide"
caaggtaggagctggagcattcggg

SEQ ID NO: 293 - DNA, 25 bp, Artificial Sequence
  source: /note="Description of Artificial Sequence: Synthetic oligonucleotide"
taggagctggagcattcgggctggg

SEQ ID NO: 294 - DNA, 25 bp, Artificial Sequence
  source: /note="Description of Artificial Sequence: Synthetic oligonucleotide"
gctgggtttcaccccaccgcacgga

SEQ ID NO: 295 - DNA, 25 bp, Artificial Sequence
  source: /note="Description of Artificial Sequence: Synthetic oligonucleotide"
ctgggtttcaccccaccgcacggag

SEQ ID NO: 296 - DNA, 25 bp, Artificial Sequence
  source: /note="Description of Artificial Sequence: Synthetic oligonucleotide"
ccccaccgcacggaggccttttggg

SEQ ID NO: 297 - DNA, 25 bp, Artificial Sequence
  source: /note="Description of Artificial Sequence: Synthetic oligonucleotide"
cccaccgcacggaggccttttgggg

SEQ ID NO: 298 - DNA, 25 bp, Artificial Sequence
  source: /note="Description of Artificial Sequence: Synthetic oligonucleotide"
ccgcacggaggccttttggggtgga

SEQ ID NO: 299 - DNA, 25 bp, Artificial Sequence
  source: /note="Description of Artificial Sequence: Synthetic oligonucleotide"
cgcacggaggccttttggggtggag

SEQ ID NO: 300 - DNA, 25 bp, Artificial Sequence
  source: /note="Description of Artificial Sequence: Synthetic oligonucleotide"
tggggtggagccctcaggctcaggg

SEQ ID NO: 301 - DNA, 25 bp, Artificial Sequence
  source: /note="Description of Artificial Sequence: Synthetic oligonucleotide"
tgcctccaccaatcgccagacagga

SEQ ID NO: 302 - DNA, 25 bp, Artificial Sequence
  source: /note="Description of Artificial Sequence: Synthetic oligonucleotide"
gcctccaccaatcgccagacaggaa

SEQ ID NO: 303 - DNA, 25 bp, Artificial Sequence
  source: /note="Description of Artificial Sequence: Synthetic oligonucleotide"
ctaccccgctgtctccacctttgag

SEQ ID NO: 304 - DNA, 25 bp, Artificial Sequence
  source: /note="Description of Artificial Sequence: Synthetic oligonucleotide"
accccgctgtctccacctttgagaa

SEQ ID NO: 305 - DNA, 17 bp, Artificial Sequence
  source: /note="Description of Artificial Sequence: Synthetic oligonucleotide"
gaaaggttgtggaattt

SEQ ID NO: 306 - DNA, 19 bp, Artificial Sequence
  source: /note="Description of Artificial Sequence: Synthetic oligonucleotide"
gtgaaaggttgtggaattc

SEQ ID NO: 307 - DNA, 23 bp, Artificial Sequence
  source: /note="Description of Artificial Sequence: Synthetic oligonucleotide"
tttggtgaaaggttgtggaatta

SEQ ID NO: 308 - DNA, 25 bp, Artificial Sequence
  source: /note="Description of Artificial Sequence: Synthetic oligonucleotide"
aggatgagtgtttctcaaaggtgga

SEQ ID NO: 309 - DNA, 25 bp, Artificial Sequence
  source: /note="Description of Artificial Sequence: Synthetic oligonucleotide"
ggatgagtgtttctcaaaggtggag

SEQ ID NO: 310 - DNA, 25 bp, Artificial Sequence
  source: /note="Description of Artificial Sequence: Synthetic oligonucleotide"
gtttctcaaaggtggagacagcggg

SEQ ID NO: 311 - DNA, 25 bp, Artificial Sequence
  source: /note="Description of Artificial Sequence: Synthetic oligonucleotide"
tttctcaaaggtggagacagcgggg

SEQ ID NO: 312 - DNA, 25 bp, Artificial Sequence
  source: /note="Description of Artificial Sequence: Synthetic oligonucleotide"
gccttcctgtctggcgattggtgga

SEQ ID NO: 313 - DNA, 25 bp, Artificial Sequence
  source: /note="Description of Artificial Sequence: Synthetic oligonucleotide"
ccttcctgtctggcgattggtggag

SEQ ID NO: 314 - DNA, 25 bp, Artificial Sequence
  source: /note="Description of Artificial Sequence: Synthetic oligonucleotide"
tgtctggcgattggtggaggcagga

SEQ ID NO: 315 - DNA, 25 bp, Artificial Sequence
  source: /note="Description of Artificial Sequence: Synthetic oligonucleotide"
gtctggcgattggtggaggcaggag

SEQ ID NO: 316 - DNA, 25 bp, Artificial Sequence
  source: /note="Description of Artificial Sequence: Synthetic oligonucleotide"
gcgattggtggaggcaggaggcgga

SEQ ID NO: 317 - DNA, 25 bp, Artificial Sequence
  source: /note="Description of Artificial Sequence: Synthetic oligonucleotide"
ggcaaagtttgtagtatgccctgag

SEQ ID NO: 318 - DNA, 25 bp, Artificial Sequence
  source: /note="Description of Artificial Sequence: Synthetic oligonucleotide"
gtttgtagtatgccctgagcctgag

SEQ ID NO: 319 - DNA, 25 bp, Artificial Sequence
  source: /note="Description of Artificial Sequence: Synthetic oligonucleotide"
ttgtagtatgccctgagcctgaggg

SEQ ID NO: 320 - DNA, 25 bp, Artificial Sequence
  source: /note="Description of Artificial Sequence: Synthetic oligonucleotide"
ccccaaaaggcctccgtgcggtggg

SEQ ID NO: 321 - DNA, 25 bp, Artificial Sequence
  source: /note="Description of Artificial Sequence: Synthetic oligonucleotide"
cccaaaaggcctccgtgcggtgggg

SEQ ID NO: 322 - DNA, 25 bp, Artificial Sequence
  source: /note="Description of Artificial Sequence: Synthetic oligonucleotide"
aaaggcctccgtgcggtggggtgaa

SEQ ID NO: 323 - DNA, 25 bp, Artificial Sequence
  source: /note="Description of Artificial Sequence: Synthetic oligonucleotide"
gcggtggggtgaaacccagcccgaa

SEQ ID NO: 324 - DNA, 25 bp, Artificial Sequence
  source: /note="Description of Artificial Sequence: Synthetic oligonucleotide"
cgtctggccaggtgtccttgttggg

SEQ ID NO: 325 - DNA, 25 bp, Artificial Sequence
  source: /note="Description of Artificial Sequence: Synthetic oligonucleotide"
gtctggccaggtgtccttgttggga

SEQ ID NO: 326 - DNA, 25 bp, Artificial Sequence
  source: /note="Description of Artificial Sequence: Synthetic oligonucleotide"
gccaggtgtccttgttgggattgaa

SEQ ID NO: 327 - DNA, 25 bp, Artificial Sequence
  source: /note="Description of Artificial Sequence: Synthetic oligonucleotide"
gttgggattgaagtcccaatctgga

SEQ ID NO: 328 - DNA, 25 bp, Artificial Sequence
  source: /note="Description of Artificial Sequence: Synthetic oligonucleotide"
ctggatttgctgtgtttgctctgaa

SEQ ID NO: 329 - DNA, 25 bp, Artificial Sequence
  source: /note="Description of Artificial Sequence: Synthetic oligonucleotide"
tgctgtgtttgctctgaaggctgga

SEQ ID NO: 330 - DNA, 25 bp, Artificial Sequence
  source: /note="Description of Artificial Sequence: Synthetic oligonucleotide"
aggctggatccaactggtggtcggg

SEQ ID NO: 331 - DNA, 25 bp, Artificial Sequence
  source: /note="Description of Artificial Sequence: Synthetic oligonucleotide"
ggctggatccaactggtggtcggga

SEQ ID NO: 332 - DNA, 25 bp, Artificial Sequence
  source: /note="Description of Artificial Sequence: Synthetic oligonucleotide"
gctggatccaactggtggtcgggaa

SEQ ID NO: 333 - DNA, 25 bp, Artificial Sequence
  source: /note="Description of Artificial Sequence: Synthetic oligonucleotide"
gatccaactggtggtcgggaaagaa

SEQ ID NO: 334 - DNA, 25 bp, Artificial Sequence
  source: /note="Description of Artificial Sequence: Synthetic oligonucleotide"
tggtggtcgggaaagaatcccagag

SEQ ID NO: 335 - DNA, 25 bp, Artificial Sequence
  source: /note="Description of Artificial Sequence: Synthetic oligonucleotide"
gtggtcgggaaagaatcccagagga

SEQ ID NO: 336 - DNA, 25 bp, Artificial Sequence
  source: /note="Description of Artificial Sequence: Synthetic oligonucleotide"
agaatcccagaggattgctggtgga

SEQ ID NO: 337 - DNA, 25 bp, Artificial Sequence
  source: /note="Description of Artificial Sequence: Synthetic oligonucleotide"
gaatcccagaggattgctggtggaa

SEQ ID NO: 338 - DNA, 25 bp, Artificial Sequence
  source: /note="Description of Artificial Sequence: Synthetic oligonucleotide"
atgctgtagatcttgttcccaagaa

SEQ ID NO: 339 - DNA, 25 bp, Artificial Sequence
  source: /note="Description of Artificial Sequence: Synthetic oligonucleotide"
agaatatggtgacccacaaaatgag

SEQ ID NO: 340 - DNA, 25 bp, Artificial Sequence
  source: /note="Description of Artificial Sequence: Synthetic oligonucleotide"
tataatatacccgccttccatagag

SEQ ID NO: 341 - DNA, 25 bp, Artificial Sequence
  source: /note="Description of Artificial Sequence: Synthetic oligonucleotide"
gtgtgtaaatagtgtctagtttgga

SEQ ID NO: 342 - DNA, 25 bp, Artificial Sequence
  source: /note="Description of Artificial Sequence: Synthetic oligonucleotide"
tgtgtaaatagtgtctagtttggaa

SEQ ID NO: 343 - DNA, 25 bp, Artificial Sequence
  source: /note="Description of Artificial Sequence: Synthetic oligonucleotide"
gtaatgattaactagatgttctgga

SEQ ID NO: 344 - DNA, 25 bp, Artificial Sequence
  source: /note="Description of Artificial Sequence: Synthetic oligonucleotide"
tggtaaatatttggtaacctttgga

SEQ ID NO: 345 - DNA, 25 bp, Artificial Sequence
  source: /note="Description of Artificial Sequence: Synthetic oligonucleotide"
tcttttctcattaactgtaagtggg

SEQ ID NO: 346 - DNA, 25 bp, Artificial Sequence
  source: /note="Description of Artificial Sequence: Synthetic oligonucleotide"
gtcttggtgtaaatgtatattagga

SEQ ID NO: 347 - DNA, 25 bp, Artificial Sequence
  source: /note="Description of Artificial Sequence: Synthetic oligonucleotide"
tcttggtgtaaatgtatattaggaa

SEQ ID NO: 348 - DNA, 25 bp, Artificial Sequence
  source: /note="Description of Artificial Sequence: Synthetic oligonucleotide"
ggaaaagatggtgttttccaatgag

SEQ ID NO: 349 - DNA, 25 bp, Artificial Sequence
  source: /note="Description of Artificial Sequence: Synthetic oligonucleotide"
aaaagatggtgttttccaatgagga

SEQ ID NO: 350 - DNA, 25 bp, Artificial Sequence
  source: /note="Description of Artificial Sequence: Synthetic oligonucleotide"
aggattaaagacaggtacagtagaa

SEQ ID NO: 351 - DNA, 25 bp, Artificial Sequence
  source: /note="Description of Artificial Sequence: Synthetic oligonucleotide"
attaaagacaggtacagtagaagaa

SEQ ID NO: 352 - DNA, 25 bp, Artificial Sequence
  source: /note="Description of Artificial Sequence: Synthetic oligonucleotide"
ccagtaaagttccccaccttatgag

SEQ ID NO: 353 - DNA, 25 bp, Artificial Sequence
  source: /note="Description of Artificial Sequence: Synthetic oligonucleotide"
gttccccaccttatgagtccaagga

SEQ ID NO: 354 - DNA, 25 bp, Artificial Sequence
  source: /note="Description of Artificial Sequence: Synthetic oligonucleotide"
ttccccaccttatgagtccaaggaa

SEQ ID NO: 355 - DNA, 25 bp, Artificial Sequence
  source: /note="Description of Artificial Sequence: Synthetic oligonucleotide"
gagtccaaggaatactaacattgag

SEQ ID NO: 356 - DNA, 25 bp, Artificial Sequence
  source: /note="Description of Artificial Sequence: Synthetic oligonucleotide"
gaatactaacattgaggttcccgag

SEQ ID NO: 357 - DNA, 25 bp, Artificial Sequence
  source: /note="Description of Artificial Sequence: Synthetic oligonucleotide"
taacattgaggttcccgagattgag

SEQ ID NO: 358 - DNA, 25 bp, Artificial Sequence
  source: /note="Description of Artificial Sequence: Synthetic oligonucleotide"
gatcttctgcgacgcggcgattgag

SEQ ID NO: 359 - DNA, 25 bp, Artificial Sequence
  source: /note="Description of Artificial Sequence: Synthetic oligonucleotide"
ggcgattgagaccttcgtctgcgag

SEQ ID NO: 360 - DNA, 25 bp, Artificial Sequence
  source: /note="Description of Artificial Sequence: Synthetic oligonucleotide"
ttgagaccttcgtctgcgaggcgag

SEQ ID NO: 361 - DNA, 25 bp, Artificial Sequence
  source: /note="Description of Artificial Sequence: Synthetic oligonucleotide"
gagaccttcgtctgcgaggcgaggg

SEQ ID NO: 362 - DNA, 25 bp, Artificial Sequence
  source: /note="Description of Artificial Sequence: Synthetic oligonucleotide"
agaccttcgtctgcgaggcgaggga

SEQ ID NO: 363 - DNA, 25 bp, Artificial Sequence
  source: /note="Description of Artificial Sequence: Synthetic oligonucleotide"
gaccttcgtctgcgaggcgagggag

SEQ ID NO: 364 - DNA, 25 bp, Artificial Sequence
  source: /note="Description of Artificial Sequence: Synthetic oligonucleotide"
aggcgagggagttcttcttctaggg

SEQ ID NO: 365 - DNA, 25 bp, Artificial Sequence
  source: /note="Description of Artificial Sequence: Synthetic oligonucleotide"
ggcgagggagttcttcttctagggg

SEQ ID NO: 366 - DNA, 25 bp, Artificial Sequence
  source: /note="Description of Artificial Sequence: Synthetic oligonucleotide"
gcgagggagttcttcttctagggga

SEQ ID NO: 367 - DNA, 25 bp, Artificial Sequence
  source: /note="Description of Artificial Sequence: Synthetic oligonucleotide"
tcgtctaacaacagtagtttccgga

SEQ ID NO: 368 - DNA, 25 bp, Artificial Sequence
  source: /note="Description of Artificial Sequence: Synthetic oligonucleotide"
cgtctaacaacagtagtttccggaa

SEQ ID NO: 369 - DNA, 25 bp, Artificial Sequence
  source: /note="Description of Artificial Sequence: Synthetic oligonucleotide"
gtagtttccggaagtgttgatagga

SEQ ID NO: 370 - DNA, 25 bp, Artificial Sequence
  source: /note="Description of Artificial Sequence: Synthetic oligonucleotide"
ttccggaagtgttgataggataggg

SEQ ID NO: 371 - DNA, 25 bp, Artificial Sequence
  source: /note="Description of Artificial Sequence: Synthetic oligonucleotide"
tccggaagtgttgataggatagggg

SEQ ID NO: 372 - DNA, 25 bp, Artificial Sequence
  source: /note="Description of Artificial Sequence: Synthetic oligonucleotide"
ggcatttggtggtctataagctgga

SEQ ID NO: 373 - DNA, 25 bp, Artificial Sequence
  source: /note="Description of Artificial Sequence: Synthetic oligonucleotide"
gcatttggtggtctataagctggag

SEQ ID NO: 374 - DNA, 25 bp, Artificial Sequence
  source: /note="Description of Artificial Sequence: Synthetic oligonucleotide"
atttggtggtctataagctggagga

SEQ ID NO: 375 - DNA, 25 bp, Artificial Sequence
  source: /note="Description of Artificial Sequence: Synthetic oligonucleotide"
tttggtggtctataagctggaggag

SEQ ID NO: 376 - DNA, 25 bp, Artificial Sequence
  source: /note="Description of Artificial Sequence: Synthetic oligonucleotide"
ggtctataagctggaggagtgcgaa

SEQ ID NO: 377 - DNA, 25 bp, Artificial Sequence
  source: /note="Description of Artificial Sequence: Synthetic oligonucleotide"
gaggagtgcgaatccacactccgaa

SEQ ID NO: 378 - DNA, 25 bp, Artificial Sequence
  source: /note="Description of Artificial Sequence: Synthetic oligonucleotide"
taacggtttctcttccaaaagtgag

SEQ ID NO: 379 - DNA, 25 bp, Artificial Sequence
  source: /note="Description of Artificial Sequence: Synthetic oligonucleotide"
ttctcttccaaaagtgagacaagaa

SEQ ID NO: 380 - DNA, 25 bp, Artificial Sequence
  source: /note="Description of Artificial Sequence: Synthetic oligonucleotide"
ccaaaagtgagacaagaaatgtgaa

SEQ ID NO: 381 - DNA, 25 bp, Artificial Sequence
  source: /note="Description of Artificial Sequence: Synthetic oligonucleotide"
gacaagaaatgtgaaaccacaagag

SEQ ID NO: 382 - DNA, 25 bp, Artificial Sequence
  source: /note="Description of Artificial Sequence: Synthetic oligonucleotide"
tgtgaaaccacaagagttgcctgaa

SEQ ID NO: 383 - DNA, 25 bp, Artificial Sequence
  source: /note="Description of Artificial Sequence: Synthetic oligonucleotide"
gactactaggtctctagatgctgga

SEQ ID NO: 384 - DNA, 25 bp, Artificial Sequence
  source: /note="Description of Artificial Sequence: Synthetic oligonucleotide"
ttaacacccacccaggtagctagag

SEQ ID NO: 385 - DNA, 25 bp, Artificial Sequence
  source: /note="Description of Artificial Sequence: Synthetic oligonucleotide"
gtcattagttccccccagcaaagaa

SEQ ID NO: 386 - DNA, 25 bp, Artificial Sequence
  source: /note="Description of Artificial Sequence: Synthetic oligonucleotide"
cccagcaaagaattgcttgcctgag

SEQ ID NO: 387 - DNA, 25 bp, Artificial Sequence
  source: /note="Description of Artificial Sequence: Synthetic oligonucleotide"
gcttgcctgagtgcagtatggtgag

SEQ ID NO: 388 - DNA, 25 bp, Artificial Sequence
  source: /note="Description of Artificial Sequence: Synthetic oligonucleotide"
cctgagtgcagtatggtgaggtgaa

SEQ ID NO: 389 - DNA, 25 bp, Artificial Sequence
  source: /note="Description of Artificial Sequence: Synthetic oligonucleotide"
atggtgaggtgaacaatgctcagga

SEQ ID NO: 390 - DNA, 25 bp, Artificial Sequence
  source: /note="Description of Artificial Sequence: Synthetic oligonucleotide"
tggtgaggtgaacaatgctcaggag

SEQ ID NO: 391 - DNA, 25 bp, Artificial Sequence
  source: /note="Description of Artificial Sequence: Synthetic oligonucleotide"
gactctaaggcttcccgatacagag

SEQ ID NO: 392 - DNA, 25 bp, Artificial Sequence
  source: /note="Description of Artificial Sequence: Synthetic oligonucleotide"
taaggcttcccgatacagagctgag

SEQ ID NO: 393 - DNA, 25 bp, Artificial Sequence
  source: /note="Description of Artificial Sequence: Synthetic oligonucleotide"
tacagagctgaggcggtatctagaa

SEQ ID NO: 394 - DNA, 25 bp, Artificial Sequence
  source: /note="Description of Artificial Sequence: Synthetic oligonucleotide"
ggtatctagaagatctcgtactgaa

SEQ ID NO: 395 - DNA, 25 bp, Artificial Sequence
  source: /note="Description of Artificial Sequence: Synthetic oligonucleotide"
atctagaagatctcgtactgaagga

SEQ ID NO: 396 - DNA, 25 bp, Artificial Sequence
  source: /note="Description of Artificial Sequence: Synthetic oligonucleotide"
tctagaagatctcgtactgaaggaa

SEQ ID NO: 397 - DNA, 25 bp, Artificial Sequence
  source: /note="Description of Artificial Sequence: Synthetic oligonucleotide"
gaagatctcgtactgaaggaaagaa

SEQ ID NO: 398 - DNA, 25 bp, Artificial Sequence
  source: /note="Description of Artificial Sequence: Synthetic oligonucleotide"
tcgtactgaaggaaagaagtcagaa

SEQ ID NO: 399 - DNA, 25 bp, Artificial Sequence
  source: /note="Description of Artificial Sequence: Synthetic oligonucleotide"
aaagaagtcagaaggcaaaaacgag

SEQ ID NO: 400 - DNA, 25 bp, Artificial Sequence
  source: /note="Description of Artificial Sequence: Synthetic oligonucleotide"
agaagtcagaaggcaaaaacgagag

SEQ ID NO: 401 - DNA, 25 bp, Artificial Sequence
  source: /note="Description of Artificial Sequence: Synthetic oligonucleotide"
agtagctccaaattctttataaggg

SEQ ID NO: 402 - DNA, 25 bp, Artificial Sequence
  source: /note="Description of Artificial Sequence: Synthetic oligonucleotide"
aaagccacccaaggcacagcttgga

SEQ ID NO: 403 - DNA, 25 bp, Artificial Sequence
  source: /note="Description of Artificial Sequence: Synthetic oligonucleotide"
aagccacccaaggcacagcttggag

SEQ ID NO: 404 - DNA, 25 bp, Artificial Sequence
  source: /note="Description of Artificial Sequence: Synthetic oligonucleotide"
ccaaggcacagcttggaggcttgaa

SEQ ID NO: 405 - DNA, 25 bp, Artificial Sequence
  source: /note="Description of Artificial Sequence: Synthetic oligonucleotide"
cagcttggaggcttgaacagtagga

SEQ ID NO: 406 - DNA, 25 bp, Artificial Sequence
  source: /note="Description of Artificial Sequence: Synthetic oligonucleotide"
ggaggcttgaacagtaggacatgaa

SEQ ID NO: 407 - DNA, 25 bp, Artificial Sequence
  source: /note="Description of Artificial Sequence: Synthetic oligonucleotide"
ttgaacagtaggacatgaacaagag

SEQ ID NO: 408 - DNA, 25 bp, Artificial Sequence
  source: /note="Description of Artificial Sequence: Synthetic oligonucleotide"
atgaacaagagatgattaggcagag

SEQ ID NO: 409 - DNA, 25 bp, Artificial Sequence
  source: /note="Description of Artificial Sequence: Synthetic oligonucleotide"
caagagatgattaggcagaggtgaa

SEQ ID NO: 410 - DNA, 25 bp, Artificial Sequence
  source: /note="Description of Artificial Sequence: Synthetic oligonucleotide"
agtctttaaacaaacagtctttgaa

SEQ ID NO: 411 - DNA, 25 bp, Artificial Sequence
  source: /note="Description of Artificial Sequence: Synthetic oligonucleotide"
aaggtcggtcgttgacattgcagag

SEQ ID NO: 412 - DNA, 25 bp, Artificial Sequence
  source: /note="Description of Artificial Sequence: Synthetic oligonucleotide"
ggtcggtcgttgacattgcagagag

SEQ ID NO: 413 - DNA, 25 bp, Artificial Sequence
  source: /note="Description of Artificial Sequence: Synthetic oligonucleotide"
gttgacattgcagagagtccaagag

SEQ ID NO: 414 - DNA, 25 bp, Artificial Sequence
  source: /note="Description of Artificial Sequence: Synthetic oligonucleotide"
gagtcctcttatgtaagaccttggg

SEQ ID NO: 415 - DNA, 25 bp, Artificial Sequence
  source: /note="Description of Artificial Sequence: Synthetic oligonucleotide"
aagaccttgggcaacattcggtggg

SEQ ID NO: 416 - DNA, 25 bp, Artificial Sequence
  source: /note="Description of Artificial Sequence: Synthetic oligonucleotide"
ggtggtctccatgcgacgtgcagag

SEQ ID NO: 417 - DNA, 25 bp, Artificial Sequence
  source: /note="Description of Artificial Sequence: Synthetic oligonucleotide"
tctccatgcgacgtgcagaggtgaa

SEQ ID NO: 418 - DNA, 25 bp, Artificial Sequence
  source: /note="Description of Artificial Sequence: Synthetic oligonucleotide"
atgcgacgtgcagaggtgaagcgaa

SEQ ID NO: 419 - DNA, 25 bp, Artificial Sequence
  source: /note="Description of Artificial Sequence: Synthetic oligonucleotide"
aagtgcacacggtccggcagatgag

SEQ ID NO: 420 - DNA, 25 bp, Artificial Sequence
  source: /note="Description of Artificial Sequence: Synthetic oligonucleotide"
gtgcacacggtccggcagatgagaa

SEQ ID NO: 421 - DNA, 25 bp, Artificial Sequence
  source: /note="Description of Artificial Sequence: Synthetic oligonucleotide"
cggcagatgagaaggcacagacggg

SEQ ID NO: 422 - DNA, 25 bp, Artificial Sequence
  source: /note="Description of Artificial Sequence: Synthetic oligonucleotide"
ggcagatgagaaggcacagacgggg

SEQ ID NO: 423 - DNA, 25 bp, Artificial Sequence
  source: /note="Description of Artificial Sequence: Synthetic oligonucleotide"
gcagatgagaaggcacagacgggga

SEQ ID NO: 424 - DNA, 25 bp, Artificial Sequence
  source: /note="Description of Artificial Sequence: Synthetic oligonucleotide"
cagatgagaaggcacagacggggag

SEQ ID NO: 425 - DNA, 25 bp, Artificial Sequence
  source: /note="Description of Artificial Sequence: Synthetic oligonucleotide"
acagacggggagtccgcgtaaagag

SEQ ID NO: 426 - DNA, 25 bp, Artificial Sequence
  source: /note="Description of Artificial Sequence: Synthetic oligonucleotide"
agacggggagtccgcgtaaagagag

SEQ ID NO: 427 - DNA, 25 bp, Artificial Sequence
  source: /note="Description of Artificial Sequence: Synthetic oligonucleotide"
gaggtgcgccccgtggtcggtcgga

SEQ ID NO: 428 - DNA, 25 bp, Artificial Sequence
  source: /note="Description of Artificial Sequence: Synthetic oligonucleotide"
aggtgcgccccgtggtcggtcggaa

SEQ ID NO: 429 - DNA, 25 bp, Artificial Sequence
  source: /note="Description of Artificial Sequence: Synthetic oligonucleotide"
gtggtcggtcggaacggcagacgga

SEQ ID NO: 430 - DNA, 25 bp, Artificial Sequence
  source: /note="Description of Artificial Sequence: Synthetic oligonucleotide"
tggtcggtcggaacggcagacggag

SEQ ID NO: 431 - DNA, 25 bp, Artificial Sequence
  source: /note="Description of Artificial Sequence: Synthetic oligonucleotide"
gtcggtcggaacggcagacggagaa

SEQ ID NO: 432 - DNA, 25 bp, Artificial Sequence
  source: /note="Description of Artificial Sequence: Synthetic oligonucleotide"
ggtcggaacggcagacggagaaggg

SEQ ID NO: 433 - DNA, 25 bp, Artificial Sequence
  source: /note="Description of Artificial Sequence: Synthetic oligonucleotide"
gtcggaacggcagacggagaagggg

SEQ ID NO: 434 - DNA, 25 bp, Artificial Sequence
  source: /note="Description of Artificial Sequence: Synthetic oligonucleotide"
tcggaacggcagacggagaagggga

SEQ ID NO: 435 - DNA, 25 bp, Artificial Sequence
  source: /note="Description of Artificial Sequence: Synthetic oligonucleotide"
aacggcagacggagaaggggacgag

SEQ ID NO: 436 - DNA, 25 bp, Artificial Sequence
  source: /note="Description of Artificial Sequence: Synthetic oligonucleotide"
cggcagacggagaaggggacgagag

SEQ ID NO: 437 - DNA, 25 bp, Artificial Sequence
  source: /note="Description of Artificial Sequence: Synthetic oligonucleotide"
gcagacggagaaggggacgagagag

SEQ ID NO: 438 - DNA, 25 bp, Artificial Sequence
  source: /note="Description of Artificial Sequence: Synthetic oligonucleotide"
cgagagagtcccaagcgaccccgag

SEQ ID NO: 439 - DNA, 25 bp, Artificial Sequence
  source: /note="Description of Artificial Sequence: Synthetic oligonucleotide"
agagagtcccaagcgaccccgagaa

SEQ ID NO: 440 - DNA, 25 bp, Artificial Sequence
  source: /note="Description of Artificial Sequence: Synthetic oligonucleotide"
gagtcccaagcgaccccgagaaggg

SEQ ID NO: 441 - DNA, 25 bp, Artificial Sequence
  source: /note="Description of Artificial Sequence: Synthetic oligonucleotide"
accccgagaagggtcgtccgcagga

SEQ ID NO: 442 - DNA, 25 bp, Artificial Sequence
  source: /note="Description of Artificial Sequence: Synthetic oligonucleotide"
gtccgcaggattcagcgccgacggg

SEQ ID NO: 443 - DNA, 25 bp, Artificial Sequence
  source: /note="Description of Artificial Sequence: Synthetic oligonucleotide"
tccgcaggattcagcgccgacggga

SEQ ID NO: 444 - DNA, 25 bp, Artificial Sequence
  source: /note="Description of Artificial Sequence: Synthetic oligonucleotide"
gcgccgacgggacgtaaacaaagga

SEQ ID NO: 445 - DNA, 25 bp, Artificial Sequence
  source: /note="Description of Artificial Sequence: Synthetic oligonucleotide"
taaacaaaggacgtcccgcgcagga

SEQ ID NO: 446 - DNA, 25 bp, Artificial Sequence
  source: /note="Description of Artificial Sequence: Synthetic oligonucleotide"
ggcagcacagcctagcagccatgga

SEQ ID NO: 447 - DNA, 25 bp, Artificial Sequence
  source: /note="Description of Artificial Sequence: Synthetic oligonucleotide"
catggatacgatgtatatttgcggg

SEQ ID NO: 448 - DNA, 25 bp, Artificial Sequence
  source: /note="Description of Artificial Sequence: Synthetic oligonucleotide"
atggatacgatgtatatttgcggga

SEQ ID NO: 449 - DNA, 25 bp, Artificial Sequence
  source: /note="Description of Artificial Sequence: Synthetic oligonucleotide"
tggatacgatgtatatttgcgggag

SEQ ID NO: 450 - DNA, 25 bp, Artificial Sequence
  source: /note="Description of Artificial Sequence: Synthetic oligonucleotide"
gatacgatgtatatttgcgggagag

SEQ ID NO: 451 - DNA, 25 bp, Artificial Sequence
  source: /note="Description of Artificial Sequence: Synthetic oligonucleotide"
tacgatgtatatttgcgggagagga

SEQ ID NO: 452 - DNA, 25 bp, Artificial Sequence
  source: /note="Description of Artificial Sequence: Synthetic oligonucleotide"
atatttgcgggagaggacaacagag

SEQ ID NO: 453 - DNA, 25 bp, Artificial Sequence
  source: /note="Description of Artificial Sequence: Synthetic oligonucleotide"
atgtttgctccagacctgctgcgag

SEQ ID NO: 454 - DNA, 25 bp, Artificial Sequence
  source: /note="Description of Artificial Sequence: Synthetic oligonucleotide"
ctgcgagcaaaacaagcggctagga

SEQ ID NO: 455 - DNA, 25 bp, Artificial Sequence
  source: /note="Description of Artificial Sequence: Synthetic oligonucleotide"
tgcgagcaaaacaagcggctaggag

SEQ ID NO: 456 - DNA, 25 bp, Artificial Sequence
  source: /note="Description of Artificial Sequence: Synthetic oligonucleotide"
gcggctaggagttccgcagtatgga

SEQ ID NO: 457 - DNA, 25 bp, Artificial Sequence
  source: /note="Description of Artificial Sequence: Synthetic oligonucleotide"
agttccgcagtatggatcggcagag

SEQ ID NO: 458 - DNA, 25 bp, Artificial Sequence
  source: /note="Description of Artificial Sequence: Synthetic oligonucleotide"
ttccgcagtatggatcggcagagga

SEQ ID NO: 459 - DNA, 25 bp, Artificial Sequence
  source: /note="Description of Artificial Sequence: Synthetic oligonucleotide"
tccgcagtatggatcggcagaggag

SEQ ID NO: 460 - DNA, 25 bp, Artificial Sequence
  source: /note="Description of Artificial Sequence: Synthetic oligonucleotide"
agtatggatcggcagaggagccgaa

SEQ ID NO: 461 - DNA, 25 bp, Artificial Sequence
  source: /note="Description of Artificial Sequence: Synthetic oligonucleotide"
ccatgaccaagccccagccagtggg

SEQ ID NO: 462 - DNA, 25 bp, Artificial Sequence
  source: /note="Description of Artificial Sequence: Synthetic oligonucleotide"
catgaccaagccccagccagtgggg

SEQ ID NO: 463 - DNA, 25 bp, Artificial Sequence
  source: /note="Description of Artificial Sequence: Synthetic oligonucleotide"
atgaccaagccccagccagtggggg

SEQ ID NO: 464 - DNA, 25 bp, Artificial Sequence
  source: /note="Description of Artificial Sequence: Synthetic oligonucleotide"
tggcacagacctggccgttgccggg

SEQ ID NO: 465 - DNA, 25 bp, Artificial Sequence
  source: /note="Description of Artificial Sequence: Synthetic oligonucleotide"
gacctggccgttgccgggcaacggg

SEQ ID NO: 466 - DNA, 25 bp, Artificial Sequence
  source: /note="Description of Artificial Sequence: Synthetic oligonucleotide"
acctggccgttgccgggcaacgggg

SEQ ID NO: 467 - DNA, 25 bp, Artificial Sequence
  source: /note="Description of Artificial Sequence: Synthetic oligonucleotide"
aggttcaggtattgtttacacagaa

SEQ ID NO: 468 - DNA, 25 bp, Artificial Sequence
  source: /note="Description of Artificial Sequence: Synthetic oligonucleotide"
cagaaaggccttgtaagttggcgag

SEQ ID NO: 469 - DNA, 25 bp, Artificial Sequence
  source: /note="Description of Artificial Sequence: Synthetic oligonucleotide"
gaaaggccttgtaagttggcgagaa

SEQ ID NO: 470 - DNA, 25 bp, Artificial Sequence
  source: /note="Description of Artificial Sequence: Synthetic oligonucleotide"
ccttgtaagttggcgagaaagtgaa

SEQ ID NO: 471 - DNA, 25 bp, Artificial Sequence
  source: /note="Description of Artificial Sequence: Synthetic oligonucleotide"
aaagtgaaagcctgcttagattgaa

SEQ ID NO: 472 - DNA, 25 bp, Artificial Sequence
  source: /note="Description of Artificial Sequence: Synthetic oligonucleotide"
tagattgaatacatgcatacaaggg

SEQ ID NO: 473 - DNA, 25 bp, Artificial Sequence
  source: /note="Description of Artificial Sequence: Synthetic oligonucleotide"
tgcatacaagggcattaacgcagga

SEQ ID NO: 474 - DNA, 25 bp, Artificial Sequence
  source: /note="Description of Artificial Sequence: Synthetic oligonucleotide"
aggataaccacattgtgtaaatggg

SEQ ID NO: 475 - DNA, 25 bp, Artificial Sequence
  source: /note="Description of Artificial Sequence: Synthetic oligonucleotide"
ggataaccacattgtgtaaatgggg

SEQ ID NO: 476 - DNA, 25 bp, Artificial Sequence
  source: /note="Description of Artificial Sequence: Synthetic oligonucleotide"
ccaatcaataggcctgttaatagga

SEQ ID NO: 477 - DNA, 25 bp, Artificial Sequence
  source: /note="Description of Artificial Sequence: Synthetic oligonucleotide"
caatcaataggcctgttaataggaa

SEQ ID NO: 478 - DNA, 25 bp, Artificial Sequence
  source: /note="Description of Artificial Sequence: Synthetic oligonucleotide"
gtatgatgtgttcttgtggcaagga

SEQ ID NO: 479 - DNA, 25 bp, Artificial Sequence
  source: /note="Description of Artificial Sequence: Synthetic oligonucleotide"
atgacataacccataaaattcagag

SEQ ID NO: 480 - DNA, 25 bp, Artificial Sequence
  source: /note="Description of Artificial Sequence: Synthetic oligonucleotide"
gacataacccataaaattcagagag

SEQ ID NO: 481 - DNA, 25 bp, Artificial Sequence
  source: /note="Description of Artificial Sequence: Synthetic oligonucleotide"
accccatctctttgttttgttaggg

SEQ ID NO: 482 - DNA, 25 bp, Artificial Sequence
  source: /note="Description of Artificial Sequence: Synthetic oligonucleotide"
aaatgtatacccaaagacaaaagaa

SEQ ID NO: 483 - DNA, 25 bp, Artificial Sequence
  source: /note="Description of Artificial Sequence: Synthetic oligonucleotide"
aaattggtaacagcggtaaaaaggg

SEQ ID NO: 484 - DNA, 25 bp, Artificial Sequence
  source: /note="Description of Artificial Sequence: Synthetic oligonucleotide"
aattggtaacagcggtaaaaaggga

SEQ ID NO: 485 - DNA, 25 bp, Artificial Sequence
  source: /note="Description of Artificial Sequence: Synthetic oligonucleotide"
ataccacatcatccatataactgaa

SEQ ID NO: 486 - DNA, 25 bp, Artificial Sequence
  source: /note="Description of Artificial Sequence: Synthetic oligonucleotide"
atataactgaaagccaaacagtggg

SEQ ID NO: 487 - DNA, 25 bp, Artificial Sequence
  source: /note="Description of Artificial Sequence: Synthetic oligonucleotide"
tataactgaaagccaaacagtgggg

SEQ ID NO: 488 - DNA, 25 bp, Artificial Sequence
  source: /note="Description of Artificial Sequence: Synthetic oligonucleotide"
ataactgaaagccaaacagtggggg

SEQ ID NO: 489 - DNA, 25 bp, Artificial Sequence
  source: /note="Description of Artificial Sequence: Synthetic oligonucleotide"
taactgaaagccaaacagtggggga

SEQ ID NO: 490 - DNA, 25 bp, Artificial Sequence
  source: /note="Description of Artificial Sequence: Synthetic oligonucleotide"
aactgaaagccaaacagtgggggaa

SEQ ID NO: 491 - DNA, 25 bp, Artificial Sequence
  source: /note="Description of Artificial Sequence: Synthetic oligonucleotide"
aaacagtgggggaaagccctacgaa

SEQ ID NO: 492 - DNA, 25 bp, Artificial Sequence
  source: /note="Description of Artificial Sequence: Synthetic oligonucleotide"
ggggaaagccctacgaaccactgaa

SEQ ID NO: 493 - DNA, 25 bp, Artificial Sequence
  source: /note="Description of Artificial Sequence: Synthetic oligonucleotide"
gaacaaatggcactagtaaactgag

SEQ ID NO: 494 - DNA, 25 bp, Artificial Sequence
  source: /note="Description of Artificial Sequence: Synthetic oligonucleotide"
atggcactagtaaactgagccagga

SEQ ID NO: 495 - DNA, 25 bp, Artificial Sequence
  source: /note="Description of Artificial Sequence: Synthetic oligonucleotide"
tggcactagtaaactgagccaggag

SEQ ID NO: 496 - DNA, 25 bp, Artificial Sequence
  source: /note="Description of Artificial Sequence: Synthetic oligonucleotide"
gcactagtaaactgagccaggagaa

SEQ ID NO: 497 - DNA, 25 bp, Artificial Sequence
  source: /note="Description of Artificial Sequence: Synthetic oligonucleotide"
agtaaactgagccaggagaaacggg

SEQ ID NO: 498 - DNA, 25 bp, Artificial Sequence
  source: /note="Description of Artificial Sequence: Synthetic oligonucleotide"
actgagccaggagaaacgggctgag

SEQ ID NO: 499 - DNA, 25 bp, Artificial Sequence
  source: /note="Description of Artificial Sequence: Synthetic oligonucleotide"
cgggctgaggcccactcccatagga

SEQ ID NO: 500 - DNA, 25 bp, Artificial Sequence
  source: /note="Description of Artificial Sequence: Synthetic oligonucleotide"
gggctgaggcccactcccataggaa

SEQ ID NO: 501 - DNA, 25 bp, Artificial Sequence
  source: /note="Description of Artificial Sequence: Synthetic oligonucleotide"
cccactcccataggaattttccgaa

SEQ ID NO: 502 - DNA, 25 bp, Artificial Sequence
  source: /note="Description of Artificial Sequence: Synthetic oligonucleotide"
ataggaattttccgaaagcccagga

SEQ ID NO: 503 - DNA, 25 bp, Artificial Sequence
  source: /note="Description of Artificial Sequence: Synthetic oligonucleotide"
ttttccgaaagcccaggatgatggg

SEQ ID NO: 504 - DNA, 25 bp, Artificial Sequence
  source: /note="Description of Artificial Sequence: Synthetic oligonucleotide"
tttccgaaagcccaggatgatggga

SEQ ID NO: 505 - DNA, 25 bp, Artificial Sequence
  source: /note="Description of Artificial Sequence: Synthetic oligonucleotide"
cgaaagcccaggatgatgggatggg

SEQ ID NO: 506 - DNA, 25 bp, Artificial Sequence
  source: /note="Description of Artificial Sequence: Synthetic oligonucleotide"
gaaagcccaggatgatgggatggga

SEQ ID NO: 507 - DNA, 25 bp, Artificial Sequence
  source: /note="Description of Artificial Sequence: Synthetic oligonucleotide"
aaagcccaggatgatgggatgggaa

SEQ ID NO: 508 - DNA, 25 bp, Artificial Sequence
  source: /note="Description of Artificial Sequence: Synthetic oligonucleotide"
aatacaggtgcaatttccgtccgaa

SEQ ID NO: 509 - DNA, 25 bp, Artificial Sequence
  source: /note="Description of Artificial Sequence: Synthetic oligonucleotide"
ccgaaggtttggtacagcaacagga

SEQ ID NO: 510 - DNA, 25 bp, Artificial Sequence
  source: /note="Description of Artificial Sequence: Synthetic oligonucleotide"
cgaaggtttggtacagcaacaggag

SEQ ID NO: 511 - DNA, 25 bp, Artificial Sequence
  source: /note="Description of Artificial Sequence: Synthetic oligonucleotide"
aaggtttggtacagcaacaggaggg

SEQ ID NO: 512 - DNA, 25 bp, Artificial Sequence
  source: /note="Description of Artificial Sequence: Synthetic oligonucleotide"
aggtttggtacagcaacaggaggga

SEQ ID NO: 513 - DNA, 25 bp, Artificial Sequence
  source: /note="Description of Artificial Sequence: Synthetic oligonucleotide"
acagcaacaggagggatacatagag

SEQ ID NO: 514 - DNA, 25 bp, Artificial Sequence
  source: /note="Description of Artificial Sequence: Synthetic oligonucleotide"
gagggatacatagaggttccttgag

SEQ ID NO: 515 - DNA, 25 bp, Artificial Sequence
  source: /note="Description of Artificial Sequence: Synthetic oligonucleotide"
gcatggtcccgtgctggtggttgag

SEQ ID NO: 516 - DNA, 25 bp, Artificial Sequence
  source: /note="Description of Artificial Sequence: Synthetic oligonucleotide"
atggtcccgtgctggtggttgagga

SEQ ID NO: 517 - DNA, 25 bp, Artificial Sequence
  source: /note="Description of Artificial Sequence: Synthetic oligonucleotide"
cgtgctggtggttgaggatcctgga

SEQ ID NO: 518 - DNA, 25 bp, Artificial Sequence
  source: /note="Description of Artificial Sequence: Synthetic oligonucleotide"
gtgctggtggttgaggatcctggaa

SEQ ID NO: 519 - DNA, 25 bp, Artificial Sequence
  source: /note="Description of Artificial Sequence: Synthetic oligonucleotide"
gtggttgaggatcctggaattagag

SEQ ID NO: 520 - DNA, 25 bp, Artificial Sequence
  source: /note="Description of Artificial Sequence: Synthetic oligonucleotide"
ggttgaggatcctggaattagagga

SEQ ID NO: 521 - DNA, 25 bp, Artificial Sequence
  source: /note="Description of Artificial Sequence: Synthetic oligonucleotide"
atcctggaattagaggacaaacggg

SEQ ID NO: 522 - DNA, 25 bp, Artificial Sequence
  source: /note="Description of Artificial Sequence: Synthetic oligonucleotide"
ggcaacataccttgatagtccagaa

SEQ ID NO: 523 - DNA, 25 bp, Artificial Sequence
  source: /note="Description of Artificial Sequence: Synthetic oligonucleotide"
aacataccttgatagtccagaagaa

SEQ ID NO: 524 - DNA, 25 bp, Artificial Sequence
  source: /note="Description of Artificial Sequence: Synthetic oligonucleotide"
gatagtccagaagaaccaacaagaa

SEQ ID NO: 525 - DNA, 25 bp, Artificial Sequence
  source: /note="Description of Artificial Sequence: Synthetic oligonucleotide"
ccagaagaaccaacaagaagatgag

SEQ ID NO: 526 - DNA, 25 bp, Artificial Sequence
  source: /note="Description of Artificial Sequence: Synthetic oligonucleotide"
aagaagatgaggcatagcagcagga

SEQ ID NO: 527 - DNA, 25 bp, Artificial Sequence
  source: /note="Description of Artificial Sequence: Synthetic oligonucleotide"
agatgaggcatagcagcaggatgaa

SEQ ID NO: 528 - DNA, 25 bp, Artificial Sequence
  source: /note="Description of Artificial Sequence: Synthetic oligonucleotide"
tgaggcatagcagcaggatgaagag

SEQ ID NO: 529 - DNA, 25 bp, Artificial Sequence
  source: /note="Description of Artificial Sequence: Synthetic oligonucleotide"
aggcatagcagcaggatgaagagga

SEQ ID NO: 530 - DNA, 25 bp, Artificial Sequence
  source: /note="Description of Artificial Sequence: Synthetic oligonucleotide"
ggcatagcagcaggatgaagaggaa

SEQ ID NO: 531 - DNA, 25 bp, Artificial Sequence
  source: /note="Description of Artificial Sequence: Synthetic oligonucleotide"
cagacacatccagcgataaccagga

SEQ ID NO: 532 - DNA, 25 bp, Artificial Sequence
  source: /note="Description of Artificial Sequence: Synthetic oligonucleotide"
ccagcgataaccaggacaagttgga

SEQ ID NO: 533 - DNA, 25 bp, Artificial Sequence
  source: /note="Description of Artificial Sequence: Synthetic oligonucleotide"
cagcgataaccaggacaagttggag

SEQ ID NO: 534 - DNA, 25 bp, Artificial Sequence
  source: /note="Description of Artificial Sequence: Synthetic oligonucleotide"
gcgataaccaggacaagttggagga

SEQ ID NO: 535 - DNA, 25 bp, Artificial Sequence
  source: /note="Description of Artificial Sequence: Synthetic oligonucleotide"
aaccaggacaagttggaggacagga

SEQ ID NO: 536 - DNA, 25 bp, Artificial Sequence
  source: /note="Description of Artificial Sequence: Synthetic oligonucleotide"
accaggacaagttggaggacaggag

SEQ ID NO: 537 - DNA, 25 bp, Artificial Sequence
  source: /note="Description of Artificial Sequence: Synthetic oligonucleotide"
agttggaggacaggaggttggtgag

SEQ ID NO: 538 - DNA, 25 bp, Artificial Sequence
  source: /note="Description of Artificial Sequence: Synthetic oligonucleotide"
gacaggaggttggtgagtgattgga

SEQ ID NO: 539 - DNA, 25 bp, Artificial Sequence
  source: /note="Description of Artificial Sequence: Synthetic oligonucleotide"
acaggaggttggtgagtgattggag

SEQ ID NO: 540 - DNA, 25 bp, Artificial Sequence
  source: /note="Description of Artificial Sequence: Synthetic oligonucleotide"
ggttggtgagtgattggaggttggg

SEQ ID NO: 541 - DNA, 25 bp, Artificial Sequence
  source: /note="Description of Artificial Sequence: Synthetic oligonucleotide"
gttggtgagtgattggaggttgggg

SEQ ID NO: 542 - DNA, 25 bp, Artificial Sequence
  source: /note="Description of Artificial Sequence: Synthetic oligonucleotide"
ttggtgagtgattggaggttgggga

SEQ ID NO: 543 - DNA, 25 bp, Artificial Sequence
  source: /note="Description of Artificial Sequence: Synthetic oligonucleotide"
gtgattggaggttggggactgcgaa

SEQ ID NO: 544 - DNA, 25 bp, Artificial Sequence
  source: /note="Description of Artificial Sequence: Synthetic oligonucleotide"
agacacacggtagttccccctagaa

SEQ ID NO: 545 - DNA, 25 bp, Artificial Sequence
  source: /note="Description of Artificial Sequence: Synthetic oligonucleotide"
cggtagttccccctagaaaattgag

SEQ ID NO: 546 - DNA, 25 bp, Artificial Sequence
  source: /note="Description of Artificial Sequence: Synthetic oligonucleotide"
gtagttccccctagaaaattgagag

SEQ ID NO: 547 - DNA, 25 bp, Artificial Sequence
  source: /note="Description of Artificial Sequence: Synthetic oligonucleotide"
agttccccctagaaaattgagagaa

SEQ ID NO: 548 - DNA, 25 bp, Artificial Sequence
  source: /note="Description of Artificial Sequence: Synthetic oligonucleotide"
aaaattgagagaagtccaccacgag

SEQ ID NO: 549 - DNA, 25 bp, Artificial Sequence
  source: /note="Description of Artificial Sequence: Synthetic oligonucleotide"
agtctagactctgcggtattgtgag

SEQ ID NO: 550 - DNA, 25 bp, Artificial Sequence
  source: /note="Description of Artificial Sequence: Synthetic oligonucleotide"
tctagactctgcggtattgtgagga

SEQ ID NO: 551 - DNA, 25 bp, Artificial Sequence
  source: /note="Description of Artificial Sequence: Synthetic oligonucleotide"
ttgtgaggattcttgtcaacaagaa

SEQ ID NO: 552 - DNA, 25 bp, Artificial Sequence
  source: /note="Description of Artificial Sequence: Synthetic oligonucleotide"
agaaaaaccccgcctgtaacacgag

SEQ ID NO: 553 - DNA, 25 bp, Artificial Sequence
  source: /note="Description of Artificial Sequence: Synthetic oligonucleotide"
aaaaaccccgcctgtaacacgagaa

SEQ ID NO: 554 - DNA, 25 bp, Artificial Sequence
  source: /note="Description of Artificial Sequence: Synthetic oligonucleotide"
aaccccgcctgtaacacgagaaggg

SEQ ID NO: 555 - DNA, 25 bp, Artificial Sequence
  source: /note="Description of Artificial Sequence: Synthetic oligonucleotide"
accccgcctgtaacacgagaagggg

SEQ ID NO: 556 - DNA, 25 bp, Artificial Sequence
  source: /note="Description of Artificial Sequence: Synthetic oligonucleotide"
tgtaacacgagaaggggtcctagga

SEQ ID NO: 557 - DNA, 25 bp, Artificial Sequence
  source: /note="Description of Artificial Sequence: Synthetic oligonucleotide"
gtaacacgagaaggggtcctaggaa

SEQ ID NO: 558 - DNA, 25 bp, Artificial Sequence
  source: /note="Description of Artificial Sequence: Synthetic oligonucleotide"
gatgttctccatgttcagcgcaggg

SEQ ID NO: 559 - DNA, 25 bp, Artificial Sequence
  source: /note="Description of Artificial Sequence: Synthetic oligonucleotide"
cagcgcagggtccccaatcctcgag

SEQ ID NO: 560 - DNA, 25 bp, Artificial Sequence
  source: /note="Description of Artificial Sequence: Synthetic oligonucleotide"
gcgcagggtccccaatcctcgagaa

SEQ ID NO: 561 - DNA, 25 bp, Artificial Sequence
  source: /note="Description of Artificial Sequence: Synthetic oligonucleotide"
tcctcgagaagattgacgataaggg

SEQ ID NO: 562 - DNA, 25 bp, Artificial Sequence
  source: /note="Description of Artificial Sequence: Synthetic oligonucleotide"
cctcgagaagattgacgataaggga

SEQ ID NO: 563 - DNA, 25 bp, Artificial Sequence
  source: /note="Description of Artificial Sequence: Synthetic oligonucleotide"
ctcgagaagattgacgataagggag

SEQ ID NO: 564 - DNA, 25 bp, Artificial Sequence
  source: /note="Description of Artificial Sequence: Synthetic oligonucleotide"
cgagaagattgacgataagggagag

SEQ ID NO: 565 - DNA, 25 bp, Artificial Sequence
  source: /note="Description of Artificial Sequence: Synthetic oligonucleotide"
cgataagggagaggcagtagtcgga

SEQ ID NO: 566 - DNA, 25 bp, Artificial Sequence
  source: /note="Description of Artificial Sequence: Synthetic oligonucleotide"
gataagggagaggcagtagtcggaa

SEQ ID NO: 567 - DNA, 25 bp, Artificial Sequence
  source: /note="Description of Artificial Sequence: Synthetic oligonucleotide"
gggagaggcagtagtcggaacaggg

SEQ ID NO: 568 - DNA, 25 bp, Artificial Sequence
  source: /note="Description of Artificial Sequence: Synthetic oligonucleotide"
cggaacagggtttactgctcctgaa

SEQ ID NO: 569 - DNA, 25 bp, Artificial Sequence
  source: /note="Description of Artificial Sequence: Synthetic oligonucleotide"
cagggtttactgctcctgaactgga

SEQ ID NO: 570 - DNA, 25 bp, Artificial Sequence
  source: /note="Description of Artificial Sequence: Synthetic oligonucleotide"
agggtttactgctcctgaactggag

SEQ ID NO: 571 - DNA, 25 bp, Artificial Sequence
  source: /note="Description of Artificial Sequence: Synthetic oligonucleotide"
tcctgaactggagccaccagcaggg

SEQ ID NO: 572 - DNA, 25 bp, Artificial Sequence
  source: /note="Description of Artificial Sequence: Synthetic oligonucleotide"
cctgaactggagccaccagcaggga

SEQ ID NO: 573 - DNA, 25 bp, Artificial Sequence
  source: /note="Description of Artificial Sequence: Synthetic oligonucleotide"
ctgaactggagccaccagcagggaa

SEQ ID NO: 574 - DNA, 25 bp, Artificial Sequence
  source: /note="Description of Artificial Sequence: Synthetic oligonucleotide"
ggaaatacaggcctctcactctggg

SEQ ID NO: 575 - DNA, 25 bp, Artificial Sequence
  source: /note="Description of Artificial Sequence: Synthetic oligonucleotide"
gaaatacaggcctctcactctggga

SEQ ID NO: 576 - DNA, 23 bp, Artificial Sequence
  source: /note="Description of Artificial Sequence: Synthetic oligonucleotide"
aacctttcaccaaactctgcaag

SEQ ID NO: 577 - DNA, 23 bp, Artificial Sequence
  source: /note="Description of Artificial Sequence: Synthetic oligonucleotide"
caccaaactctgcaagatcccag

SEQ ID NO: 578 - DNA, 23 bp, Artificial Sequence
  source: /note="Description of Artificial Sequence: Synthetic oligonucleotide"
ccaaactctgcaagatcccagag

SEQ ID NO: 579 - DNA, 23 bp, Artificial Sequence
  source: /note="Description of Artificial Sequence: Synthetic oligonucleotide"
actctgcaagatcccagagtgag

SEQ ID NO: 580 - DNA, 23 bp, Artificial Sequence
  source: /note="Description of Artificial Sequence: Synthetic oligonucleotide"
tctgcaagatcccagagtgagag

SEQ ID NO: 581 - DNA, 23 bp, Artificial Sequence
  source: /note="Description of Artificial Sequence: Synthetic oligonucleotide"
ctgcaagatcccagagtgagagg

SEQ ID NO: 582 - DNA, 23 bp, Artificial Sequence
  source: /note="Description of Artificial Sequence: Synthetic oligonucleotide"
agaggcctgtatttccctgctgg

SEQ ID NO: 583 - DNA, 23 bp, Artificial Sequence
  source: /note="Description of Artificial Sequence: Synthetic oligonucleotide"
ggcctgtatttccctgctggtgg

SEQ ID NO: 584 - DNA, 23 bp, Artificial Sequence
  source: /note="Description of Artificial Sequence: Synthetic oligonucleotide"
tatttccctgctggtggctccag

SEQ ID NO: 585 - DNA, 23 bp, Artificial Sequence
  source: /note="Description of Artificial Sequence: Synthetic oligonucleotide"
ccctgctggtggctccagttcag

SEQ ID NO: 586 - DNA, 23 bp, Artificial Sequence
  source: /note="Description of Artificial Sequence: Synthetic oligonucleotide"
cctgctggtggctccagttcagg

SEQ ID NO: 587 - DNA, 23 bp, Artificial Sequence
  source: /note="Description of Artificial Sequence: Synthetic oligonucleotide"
tgctggtggctccagttcaggag

SEQ ID NO: 588 - DNA, 23 bp, Artificial Sequence
  source: /note="Description of Artificial Sequence: Synthetic oligonucleotide"
tggtggctccagttcaggagcag

SEQ ID NO: 589 - DNA, 23 bp, Artificial Sequence
  source: /note="Description of Artificial Sequence: Synthetic oligonucleotide"
cccttatcgtcaatcttctcgag

SEQ ID NO: 590 - DNA, 23 bp, Artificial Sequence
  source: /note="Description of Artificial Sequence: Synthetic oligonucleotide"
ccttatcgtcaatcttctcgagg

SEQ ID NO: 591 - DNA, 23 bp, Artificial Sequence
  source: /note="Description of Artificial Sequence: Synthetic oligonucleotide"
tcgtcaatcttctcgaggattgg

SEQ ID NO: 592 - DNA, 23 bp, Artificial Sequence
  source: /note="Description of Artificial Sequence: Synthetic oligonucleotide"
cgtcaatcttctcgaggattggg

SEQ ID NO: 593 - DNA, 23 bp, Artificial Sequence
  source: /note="Description of Artificial Sequence: Synthetic oligonucleotide"
gtcaatcttctcgaggattgggg

SEQ ID NO: 594 - DNA, 23 bp, Artificial Sequence
  source: /note="Description of Artificial Sequence: Synthetic oligonucleotide"
tggggaccctgcgctgaacatgg

SEQ ID NO: 595 - DNA, 23 bp, Artificial Sequence
  source: /note="Description of Artificial Sequence: Synthetic oligonucleotide"
gggaccctgcgctgaacatggag

SEQ ID NO: 596 - DNA, 23 bp, Artificial Sequence
  source: /note="Description of Artificial Sequence: Synthetic oligonucleotide"
gaacatggagaacatcacatcag

SEQ ID NO: 597 - DNA, 23 bp, Artificial Sequence
  source: /note="Description of Artificial Sequence: Synthetic oligonucleotide"
aacatggagaacatcacatcagg

SEQ ID NO: 598 - DNA, 23 bp, Artificial Sequence
  source: /note="Description of Artificial Sequence: Synthetic oligonucleotide"
gaacatcacatcaggattcctag

SEQ ID NO: 599 - DNA, 23 bp, Artificial Sequence
  source: /note="Description of Artificial Sequence: Synthetic oligonucleotide"
aacatcacatcaggattcctagg

SEQ ID NO: 600 - DNA, 23 bp, Artificial Sequence
  source: /note="Description of Artificial Sequence: Synthetic oligonucleotide"
taggaccccttctcgtgttacag

SEQ ID NO: 601 - DNA, 23 bp, Artificial Sequence
  source: /note="Description of Artificial Sequence: Synthetic oligonucleotide"
aggaccccttctcgtgttacagg

SEQ ID NO: 602 - DNA, 23 bp, Artificial Sequence
  source: /note="Description of Artificial Sequence: Synthetic oligonucleotide"
accccttctcgtgttacaggcgg

SEQ ID NO: 603 - DNA, 23 bp, Artificial Sequence
  source: /note="Description of Artificial Sequence: Synthetic oligonucleotide"
ccccttctcgtgttacaggcggg

SEQ ID NO: 604 - DNA, 23 bp, Artificial Sequence
  source: /note="Description of Artificial Sequence: Synthetic oligonucleotide"
cccttctcgtgttacaggcgggg

SEQ ID NO: 605 - DNA, 23 bp, Artificial Sequence
  source: /note="Description of Artificial Sequence: Synthetic oligonucleotide"
gcggggtttttcttgttgacaag

SEQ ID NO: 606 - DNA, 23 bp, Artificial Sequence
  source: /note="Description of Artificial Sequence: Synthetic oligonucleotide"
caagaatcctcacaataccgcag

SEQ ID NO: 607 - DNA, 23 bp, Artificial Sequence
  source: /note="Description of Artificial Sequence: Synthetic oligonucleotide"
agaatcctcacaataccgcagag

SEQ ID NO: 608 - DNA, 23 bp, Artificial Sequence
  source: /note="Description of Artificial Sequence: Synthetic oligonucleotide"
cctcacaataccgcagagtctag

SEQ ID NO: 609 - DNA, 23 bp, Artificial Sequence
  source: /note="Description of Artificial Sequence: Synthetic oligonucleotide"
taccgcagagtctagactcgtgg

SEQ ID NO: 610 - DNA, 23 bp, Artificial Sequence
  source: /note="Description of Artificial Sequence: Synthetic oligonucleotide"
cgcagagtctagactcgtggtgg

SEQ ID NO: 611 - DNA, 23 bp, Artificial Sequence
  source: /note="Description of Artificial Sequence: Synthetic oligonucleotide"
gtggacttctctcaattttctag

SEQ ID NO: 612 - DNA, 23 bp, Artificial Sequence
  source: /note="Description of Artificial Sequence: Synthetic oligonucleotide"
tggacttctctcaattttctagg

SEQ ID NO: 613 - DNA, 23 bp, Artificial Sequence
  source: /note="Description of Artificial Sequence: Synthetic oligonucleotide"
ggacttctctcaattttctaggg

SEQ ID NO: 614 - DNA, 23 bp, Artificial Sequence
  source: /note="Description of Artificial Sequence: Synthetic oligonucleotide"
gacttctctcaattttctagggg

SEQ ID NO: 615 - DNA, 23 bp, Artificial Sequence
  source: /note="Description of Artificial Sequence: Synthetic oligonucleotide"
acttctctcaattttctaggggg

SEQ ID NO: 616 - DNA, 23 bp, Artificial Sequence
  source: /note="Description of Artificial Sequence: Synthetic oligonucleotide"
gggggaactaccgtgtgtcttgg

SEQ ID NO: 617 - DNA, 23 bp, Artificial Sequence
  source: /note="Description of Artificial Sequence: Synthetic oligonucleotide"
tgtgtcttggccaaaattcgcag

SEQ ID NO: 618 - DNA, 23 bp, Artificial Sequence
  source: /note="Description of Artificial Sequence: Synthetic oligonucleotide"
tcctgtcctccaacttgtcctgg

SEQ ID NO: 619 - DNA, 23 bp, Artificial Sequence
  source: /note="Description of Artificial Sequence: Synthetic oligonucleotide"
caacttgtcctggttatcgctgg

SEQ ID NO: 620 - DNA, 23 bp, Artificial Sequence
  source: /note="Description of Artificial Sequence: Synthetic oligonucleotide"
gttatcgctggatgtgtctgcgg

SEQ ID NO: 621 - DNA, 23 bp, Artificial Sequence
  source: /note="Description of Artificial Sequence: Synthetic oligonucleotide"
gctatgcctcatcttcttgttgg

SEQ ID NO: 622 - DNA, 23 bp, Artificial Sequence
  source: /note="Description of Artificial Sequence: Synthetic oligonucleotide"
catcttcttgttggttcttctgg

SEQ ID NO: 623 - DNA, 23 bp, Artificial Sequence
  source: /note="Description of Artificial Sequence: Synthetic oligonucleotide"
gttggttcttctggactatcaag

SEQ ID NO: 624 - DNA, 23 bp, Artificial Sequence
  source: /note="Description of Artificial Sequence: Synthetic oligonucleotide"
ttggttcttctggactatcaagg

SEQ ID NO: 625 - DNA, 23 bp, Artificial Sequence
  source: /note="Description of Artificial Sequence: Synthetic oligonucleotide"
gcccgtttgtcctctaattccag

SEQ ID NO: 626 - DNA, 23 bp, Artificial Sequence
  source: /note="Description of Artificial Sequence: Synthetic oligonucleotide"
cccgtttgtcctctaattccagg

SEQ ID NO: 627 - DNA, 23 bp, Artificial Sequence
  source: /note="Description of Artificial Sequence: Synthetic oligonucleotide"
attccaggatcctcaaccaccag

SEQ ID NO: 628 - DNA, 23 bp, Artificial Sequence
  source: /note="Description of Artificial Sequence: Synthetic oligonucleotide"
aggatcctcaaccaccagcacgg

SEQ ID NO: 629 - DNA, 23 bp, Artificial Sequence
  source: /note="Description of Artificial Sequence: Synthetic oligonucleotide"
ggatcctcaaccaccagcacggg

SEQ ID NO: 630 - DNA, 23 bp, Artificial Sequence
  source: /note="Description of Artificial Sequence: Synthetic oligonucleotide"
aacctgcatgactactgctcaag

SEQ ID NO: 631 - DNA, 23 bp, Artificial Sequence
  source: /note="Description of Artificial Sequence: Synthetic oligonucleotide"
acctgcatgactactgctcaagg

SEQ ID NO: 632 - DNA, 23 bp, Artificial Sequence
  source: /note="Description of Artificial Sequence: Synthetic oligonucleotide"
ctgttgctgtaccaaaccttcgg

SEQ ID NO: 633 - DNA, 23 bp, Artificial Sequence
  source: /note="Description of Artificial Sequence: Synthetic oligonucleotide"
tgctgtaccaaaccttcggacgg

SEQ ID NO: 634 - DNA, 23 bp, Artificial Sequence
  source: /note="Description of Artificial Sequence: Synthetic oligonucleotide"
gtattcccatcccatcatcctgg

SEQ ID NO: 635 - DNA, 23 bp, Artificial Sequence
  source: /note="Description of Artificial Sequence: Synthetic oligonucleotide"
tattcccatcccatcatcctggg

SEQ ID NO: 636 - DNA, 23 bp, Artificial Sequence
  source: /note="Description of Artificial Sequence: Synthetic oligonucleotide"
atcccatcatcctgggctttcgg

SEQ ID NO: 637 - DNA, 23 bp, Artificial Sequence
  source: /note="Description of Artificial Sequence: Synthetic oligonucleotide"
gggctttcggaaaattcctatgg

SEQ ID NO: 638 - DNA, 23 bp, Artificial Sequence
  source: /note="Description of Artificial Sequence: Synthetic oligonucleotide"
ggctttcggaaaattcctatggg

SEQ ID NO: 639 - DNA, 23 bp, Artificial Sequence
  source: /note="Description of Artificial Sequence: Synthetic oligonucleotide"
ctttcggaaaattcctatgggag

SEQ ID NO: 640 - DNA, 23 bp, Artificial Sequence
  source: /note="Description of Artificial Sequence: Synthetic oligonucleotide"
tcggaaaattcctatgggagtgg

SEQ ID NO: 641 - DNA, 23 bp, Artificial Sequence
  source: /note="Description of Artificial Sequence: Synthetic oligonucleotide"
cggaaaattcctatgggagtggg

SEQ ID NO: 642 - DNA, 23 bp, Artificial Sequence
  source: /note="Description of Artificial Sequence: Synthetic oligonucleotide"
attcctatgggagtgggcctcag

SEQ ID NO: 643 - DNA, 23 bp, Artificial Sequence
  source: /note="Description of Artificial Sequence: Synthetic oligonucleotide"
gggcctcagcccgtttctcctgg

SEQ ID NO: 644 - DNA, 23 bp, Artificial Sequence
  source: /note="Description of Artificial Sequence: Synthetic oligonucleotide"
tcagcccgtttctcctggctcag

SEQ ID NO: 645 - DNA, 23 bp, Artificial Sequence
  source: /note="Description of Artificial Sequence: Synthetic oligonucleotide"
tttctcctggctcagtttactag

SEQ ID NO: 646 - DNA, 23 bp, Artificial Sequence
  source: /note="Description of Artificial Sequence: Synthetic oligonucleotide"
gtttactagtgccatttgttcag

SEQ ID NO: 647 - DNA, 23 bp, Artificial Sequence
  source: /note="Description of Artificial Sequence: Synthetic oligonucleotide"
tactagtgccatttgttcagtgg

SEQ ID NO: 648 - DNA, 23 bp, Artificial Sequence
  source: /note="Description of Artificial Sequence: Synthetic oligonucleotide"
gccatttgttcagtggttcgtag

SEQ ID NO: 649 - DNA, 23 bp, Artificial Sequence
  source: /note="Description of Artificial Sequence: Synthetic oligonucleotide"
ccatttgttcagtggttcgtagg

SEQ ID NO: 650 - DNA, 23 bp, Artificial Sequence
  source: /note="Description of Artificial Sequence: Synthetic oligonucleotide"
catttgttcagtggttcgtaggg

SEQ ID NO: 651 - DNA, 23 bp, Artificial Sequence
  source: /note="Description of Artificial Sequence: Synthetic oligonucleotide"
tagggctttcccccactgtttgg

SEQ ID NO: 652 - DNA, 23 bp, Artificial Sequence
  source: /note="Description of Artificial Sequence: Synthetic oligonucleotide"
ttcccccactgtttggctttcag

SEQ ID NO: 653 - DNA, 23 bp, Artificial Sequence
  source: /note="Description of Artificial Sequence: Synthetic oligonucleotide"
ctgtttggctttcagttatatgg

SEQ ID NO: 654 - DNA, 23 bp, Artificial Sequence
  source: /note="Description of Artificial Sequence: Synthetic oligonucleotide"
tttcagttatatggatgatgtgg

SEQ ID NO: 655 - DNA, 23 bp, Artificial Sequence
  source: /note="Description of Artificial Sequence: Synthetic oligonucleotide"
ttatatggatgatgtggtattgg

SEQ ID NO: 656 - DNA, 23 bp, Artificial Sequence
  source: /note="Description of Artificial Sequence: Synthetic oligonucleotide"
tatatggatgatgtggtattggg

SEQ ID NO: 657 - DNA, 23 bp, Artificial Sequence
  source: /note="Description of Artificial Sequence: Synthetic oligonucleotide"
atatggatgatgtggtattgggg

SEQ ID NO: 658 - DNA, 23 bp, Artificial Sequence
  source: /note="Description of Artificial Sequence: Synthetic oligonucleotide"
tatggatgatgtggtattggggg

SEQ ID NO: 659 - DNA, 23 bp, Artificial Sequence
  source: /note="Description of Artificial Sequence: Synthetic oligonucleotide"
atgatgtggtattgggggccaag

SEQ ID NO: 660 - DNA, 23 bp, Artificial Sequence
  source: /note="Description of Artificial Sequence: Synthetic oligonucleotide"
tattgggggccaagtctgtacag

SEQ ID NO: 661 - DNA, 23 bp, Artificial Sequence
  source: /note="Description of Artificial Sequence: Synthetic oligonucleotide"
ccaagtctgtacagcatcttgag

SEQ ID NO: 662 - DNA, 23 bp, Artificial Sequence
  source: /note="Description of Artificial Sequence: Synthetic oligonucleotide"
taccaattttcttttgtctttgg

SEQ ID NO: 663 - DNA, 23 bp, Artificial Sequence
  source: /note="Description of Artificial Sequence: Synthetic oligonucleotide"
accaattttcttttgtctttggg

SEQ ID NO: 664 - DNA, 23 bp, Artificial Sequence
  source: /note="Description of Artificial Sequence: Synthetic oligonucleotide"
atttaaaccctaacaaaacaaag

SEQ ID NO: 665 - DNA, 23 bp, Artificial Sequence
  source: /note="Description of Artificial Sequence: Synthetic oligonucleotide"
ttaaaccctaacaaaacaaagag

SEQ ID NO: 666 - DNA, 23 bp, Artificial Sequence
  source: /note="Description of Artificial Sequence: Synthetic oligonucleotide"
accctaacaaaacaaagagatgg

SEQ ID NO: 667 - DNA, 23 bp, Artificial Sequence
  source: /note="Description of Artificial Sequence: Synthetic oligonucleotide"
ccctaacaaaacaaagagatggg

SEQ ID NO: 668 - DNA, 23 bp, Artificial Sequence
  source: /note="Description of Artificial Sequence: Synthetic oligonucleotide"
cctaacaaaacaaagagatgggg

SEQ ID NO: 669 - DNA, 23 bp, Artificial Sequence
  source: /note="Description of Artificial Sequence: Synthetic oligonucleotide"
gggttactctctgaattttatgg

SEQ ID NO: 670 - DNA, 23 bp, Artificial Sequence
  source: /note="Description of Artificial Sequence: Synthetic oligonucleotide"
ggttactctctgaattttatggg

SEQ ID NO: 671 - DNA, 23 bp, Artificial Sequence
  source: /note="Description of Artificial Sequence: Synthetic oligonucleotide"
aattttatgggttatgtcattgg

SEQ ID NO: 672 - DNA, 23 bp, Artificial Sequence
  source: /note="Description of Artificial Sequence: Synthetic oligonucleotide"
tttatgggttatgtcattggaag

SEQ ID NO: 673 - DNA, 23 bp, Artificial Sequence
  source: /note="Description of Artificial Sequence: Synthetic oligonucleotide"
ggttatgtcattggaagttatgg

SEQ ID NO: 674 - DNA, 23 bp, Artificial Sequence
  source: /note="Description of Artificial Sequence: Synthetic oligonucleotide"
gttatgtcattggaagttatggg

SEQ ID NO: 675 - DNA, 23 bp, Artificial Sequence
  source: /note="Description of Artificial Sequence: Synthetic oligonucleotide"
aagttatgggtccttgccacaag

SEQ ID NO: 676 - DNA, 23 bp, Artificial Sequence
  source: /note="Description of Artificial Sequence: Synthetic oligonucleotide"
acacatcatacaaaaaatcaaag

SEQ ID NO: 677 - DNA, 23 bp, Artificial Sequence
  source: /note="Description of Artificial Sequence: Synthetic oligonucleotide"
caaaaaatcaaagaatgttttag

SEQ ID NO: 678 - DNA, 23 bp, Artificial Sequence
  source: /note="Description of Artificial Sequence: Synthetic oligonucleotide"
tttagaaaacttcctattaacag

SEQ ID NO: 679 - DNA, 23 bp, Artificial Sequence
  source: /note="Description of Artificial Sequence: Synthetic oligonucleotide"
ttagaaaacttcctattaacagg

SEQ ID NO: 680 - DNA, 23 bp, Artificial Sequence
  source: /note="Description of Artificial Sequence: Synthetic oligonucleotide"
ctattaacaggcctattgattgg

SEQ ID NO: 681 - DNA, 23 bp, Artificial Sequence
  source: /note="Description of Artificial Sequence: Synthetic oligonucleotide"
taacaggcctattgattggaaag

SEQ ID NO: 682 - DNA, 23 bp, Artificial Sequence
  source: /note="Description of Artificial Sequence: Synthetic oligonucleotide"
gaaagtatgtcaacgaattgtgg

SEQ ID NO: 683 - DNA, 23 bp, Artificial Sequence
  source: /note="Description of Artificial Sequence: Synthetic oligonucleotide"
aaagtatgtcaacgaattgtggg

SEQ ID NO: 684 - DNA, 23 bp, Artificial Sequence
  source: /note="Description of Artificial Sequence: Synthetic oligonucleotide"
tcaacgaattgtgggtcttttgg

SEQ ID NO: 685 - DNA, 23 bp, Artificial Sequence
  source: /note="Description of Artificial Sequence: Synthetic oligonucleotide"
caacgaattgtgggtcttttggg

SEQ ID NO: 686 - DNA, 23 bp, Artificial Sequence
  source: /note="Description of Artificial Sequence: Synthetic oligonucleotide"
gctgccccatttacacaatgtgg

SEQ ID NO: 687 - DNA, 23 bp, Artificial Sequence
  source: /note="Description of Artificial Sequence: Synthetic oligonucleotide"
tgtatgcatgtattcaatctaag

SEQ ID NO: 688 - DNA, 23 bp, Artificial Sequence
  source: /note="Description of Artificial Sequence: Synthetic oligonucleotide"
atgcatgtattcaatctaagcag

SEQ ID NO: 689 - DNA, 23 bp, Artificial Sequence
  source: /note="Description of Artificial Sequence: Synthetic oligonucleotide"
tgcatgtattcaatctaagcagg

SEQ ID NO: 690 - DNA, 23 bp, Artificial Sequence
  source: /note="Description of Artificial Sequence: Synthetic oligonucleotide"
tcactttctcgccaacttacaag

SEQ ID NO: 691 - DNA, 23 bp, Artificial Sequence
  source: /note="Description of Artificial Sequence: Synthetic oligonucleotide"
cactttctcgccaacttacaagg

SEQ ID NO: 692 - DNA, 23 bp, Artificial Sequence
  source: /note="Description of Artificial Sequence: Synthetic oligonucleotide"
tgaacctttaccccgttgcccgg

SEQ ID NO: 693 - DNA, 23 bp, Artificial Sequence
  source: /note="Description of Artificial Sequence: Synthetic oligonucleotide"
tttaccccgttgcccggcaacgg

SEQ ID NO: 694 - DNA, 23 bp, Artificial Sequence
  source: /note="Description of Artificial Sequence: Synthetic oligonucleotide"
ccccgttgcccggcaacggccag

SEQ ID NO: 695 - DNA, 23 bp, Artificial Sequence
  source: /note="Description of Artificial Sequence: Synthetic oligonucleotide"
cccgttgcccggcaacggccagg

SEQ ID NO: 696 - DNA, 23 bp, Artificial Sequence
  source: /note="Description of Artificial Sequence: Synthetic oligonucleotide"
gcaacggccaggtctgtgccaag

SEQ ID NO: 697 - DNA, 23 bp, Artificial Sequence
  source: /note="Description of Artificial Sequence: Synthetic oligonucleotide"
tttgctgacgcaacccccactgg

SEQ ID NO: 698 - DNA, 23 bp, Artificial Sequence
  source: /note="Description of Artificial Sequence: Synthetic oligonucleotide"
ctgacgcaacccccactggctgg

SEQ ID NO: 699 - DNA, 23 bp, Artificial Sequence
  source: /note="Description of Artificial Sequence: Synthetic oligonucleotide"
tgacgcaacccccactggctggg

SEQ ID NO: 700 - DNA, 23 bp, Artificial Sequence
  source: /note="Description of Artificial Sequence: Synthetic oligonucleotide"
gacgcaacccccactggctgggg

SEQ ID NO: 701 - DNA, 23 bp, Artificial Sequence
  source: /note="Description of Artificial Sequence: Synthetic oligonucleotide"
aacccccactggctggggcttgg

SEQ ID NO: 702 - DNA, 23 bp, Artificial Sequence
  source: /note="Description of Artificial Sequence: Synthetic oligonucleotide"
cactggctggggcttggtcatgg

SEQ ID NO: 703 - DNA, 23 bp, Artificial Sequence
  source: /note="Description of Artificial Sequence: Synthetic oligonucleotide"
actggctggggcttggtcatggg

SEQ ID NO: 704 - DNA, 23 bp, Artificial Sequence
  source: /note="Description of Artificial Sequence: Synthetic oligonucleotide"
ggggcttggtcatgggccatcag

SEQ ID NO: 705 - DNA, 23 bp, Artificial Sequence
  source: /note="Description of Artificial Sequence: Synthetic oligonucleotide"
atgggccatcagcgcgtgcgtgg

SEQ ID NO: 706 - DNA, 23 bp, Artificial Sequence
  source: /note="Description of Artificial Sequence: Synthetic oligonucleotide"
gcgcgtgcgtggaaccttttcgg

SEQ ID NO: 707 - DNA, 23 bp, Artificial Sequence
  source: /note="Description of Artificial Sequence: Synthetic oligonucleotide"
tcctctgccgatccatactgcgg

SEQ ID NO: 708 - DNA, 23 bp, Artificial Sequence
  source: /note="Description of Artificial Sequence: Synthetic oligonucleotide"
gatccatactgcggaactcctag

SEQ ID NO: 709 - DNA, 23 bp, Artificial Sequence
  source: /note="Description of Artificial Sequence: Synthetic oligonucleotide"
ctagccgcttgttttgctcgcag

SEQ ID NO: 710 - DNA, 23 bp, Artificial Sequence
  source: /note="Description of Artificial Sequence: Synthetic oligonucleotide"
gccgcttgttttgctcgcagcag

SEQ ID NO: 711 - DNA, 23 bp, Artificial Sequence
  source: /note="Description of Artificial Sequence: Synthetic oligonucleotide"
ccgcttgttttgctcgcagcagg

SEQ ID NO: 712 - DNA, 23 bp, Artificial Sequence
  source: /note="Description of Artificial Sequence: Synthetic oligonucleotide"
tgttttgctcgcagcaggtctgg

SEQ ID NO: 713 - DNA, 23 bp, Artificial Sequence
  source: /note="Description of Artificial Sequence: Synthetic oligonucleotide"
ttttgctcgcagcaggtctggag

SEQ ID NO: 714 - DNA, 23 bp, Artificial Sequence
  source: /note="Description of Artificial Sequence: Synthetic oligonucleotide"
aggtctggagcaaacattatcgg

SEQ ID NO: 715 - DNA, 23 bp, Artificial Sequence
  source: /note="Description of Artificial Sequence: Synthetic oligonucleotide"
ggtctggagcaaacattatcggg

SEQ ID NO: 716 - DNA, 23 bp, Artificial Sequence
  source: /note="Description of Artificial Sequence: Synthetic oligonucleotide"
gcaaatatacatcgtatccatgg

SEQ ID NO: 717 - DNA, 23 bp, Artificial Sequence
  source: /note="Description of Artificial Sequence: Synthetic oligonucleotide"
tacatcgtatccatggctgctag

SEQ ID NO: 718 - DNA, 23 bp, Artificial Sequence
  source: /note="Description of Artificial Sequence: Synthetic oligonucleotide"
acatcgtatccatggctgctagg

SEQ ID NO: 719 - DNA, 23 bp, Artificial Sequence
  source: /note="Description of Artificial Sequence: Synthetic oligonucleotide"
tgctaggctgtgctgccaactgg

SEQ ID NO: 720 - DNA, 23 bp, Artificial Sequence
  source: /note="Description of Artificial Sequence: Synthetic oligonucleotide"
gctgccaactggatcctgcgcgg

SEQ ID NO: 721 - DNA, 23 bp, Artificial Sequence
  source: /note="Description of Artificial Sequence: Synthetic oligonucleotide"
ctgccaactggatcctgcgcggg

SEQ ID NO: 722 - DNA, 23 bp, Artificial Sequence
  source: /note="Description of Artificial Sequence: Synthetic oligonucleotide"
gtcctttgtttacgtcccgtcgg

SEQ ID NO: 723 - DNA, 23 bp, Artificial Sequence
  source: /note="Description of Artificial Sequence: Synthetic oligonucleotide"
cccgtcggcgctgaatcctgcgg

SEQ ID NO: 724 - DNA, 23 bp, Artificial Sequence
  source: /note="Description of Artificial Sequence: Synthetic oligonucleotide"
atcctgcggacgacccttctcgg

SEQ ID NO: 725 - DNA, 23 bp, Artificial Sequence
  source: /note="Description of Artificial Sequence: Synthetic oligonucleotide"
tcctgcggacgacccttctcggg

SEQ ID NO: 726 - DNA, 23 bp, Artificial Sequence
  source: /note="Description of Artificial Sequence: Synthetic oligonucleotide"
cctgcggacgacccttctcgggg

SEQ ID NO: 727 - DNA, 23 bp, Artificial Sequence
  source: /note="Description of Artificial Sequence: Synthetic oligonucleotide"
cgacccttctcggggtcgcttgg

SEQ ID NO: 728 - DNA, 23 bp, Artificial Sequence
  source: /note="Description of Artificial Sequence: Synthetic oligonucleotide"
gacccttctcggggtcgcttggg

SEQ ID NO: 729 - DNA, 23 bp, Artificial Sequence
  source: /note="Description of Artificial Sequence: Synthetic oligonucleotide"
tctgccgttccgaccgaccacgg

SEQ ID NO: 730 - DNA, 23 bp, Artificial Sequence
  source: /note="Description of Artificial Sequence: Synthetic oligonucleotide"
ctgccgttccgaccgaccacggg

SEQ ID NO: 731 - DNA, 23 bp, Artificial Sequence
  source: /note="Description of Artificial Sequence: Synthetic oligonucleotide"
tgccgttccgaccgaccacgggg

SEQ ID NO: 732 - DNA, 23 bp, Artificial Sequence
  source: /note="Description of Artificial Sequence: Synthetic oligonucleotide"
ggggcgcacctctctttacgcgg

SEQ ID NO: 733 - DNA, 23 bp, Artificial Sequence
  source: /note="Description of Artificial Sequence: Synthetic oligonucleotide"
gtctgtgccttctcatctgccgg

SEQ ID NO: 734 - DNA, 23 bp, Artificial Sequence
  source: /note="Description of Artificial Sequence: Synthetic oligonucleotide"
cttcacctctgcacgtcgcatgg

SEQ ID NO: 735 - DNA, 23 bp, Artificial Sequence
  source: /note="Description of Artificial Sequence: Synthetic oligonucleotide"
tcacctctgcacgtcgcatggag

SEQ ID NO: 736 - DNA, 23 bp, Artificial Sequence
  source: /note="Description of Artificial Sequence: Synthetic oligonucleotide"
acgcccaccgaatgttgcccaag

SEQ ID NO: 737 - DNA, 23 bp, Artificial Sequence
  source: /note="Description of Artificial Sequence: Synthetic oligonucleotide"
cgcccaccgaatgttgcccaagg

SEQ ID NO: 738 - DNA, 23 bp, Artificial Sequence
  source: /note="Description of Artificial Sequence: Synthetic oligonucleotide"
tgttgcccaaggtcttacataag

SEQ ID NO: 739 - DNA, 23 bp, Artificial Sequence
  source: /note="Description of Artificial Sequence: Synthetic oligonucleotide"
ttgcccaaggtcttacataagag

SEQ ID NO: 740 - DNA, 23 bp, Artificial Sequence
  source: /note="Description of Artificial Sequence: Synthetic oligonucleotide"
tgcccaaggtcttacataagagg

SEQ ID NO: 741 - DNA, 23 bp, Artificial Sequence
  source: /note="Description of Artificial Sequence: Synthetic oligonucleotide"
gtcttacataagaggactcttgg

SEQ ID NO: 742 - DNA, 23 bp, Artificial Sequence
  source: /note="Description of Artificial Sequence: Synthetic oligonucleotide"
caatgtcaacgaccgaccttgag

SEQ ID NO: 743 - DNA, 23 bp, Artificial Sequence
  source: /note="Description of Artificial Sequence: Synthetic oligonucleotide"
aatgtcaacgaccgaccttgagg

SEQ ID NO: 744 - DNA, 23 bp, Artificial Sequence
  source: /note="Description of Artificial Sequence: Synthetic oligonucleotide"
cgaccttgaggcatacttcaaag

SEQ ID NO: 745 - DNA, 23 bp, Artificial Sequence
  source: /note="Description of Artificial Sequence: Synthetic oligonucleotide"
cttcaaagactgtttgtttaaag

SEQ ID NO: 746 - DNA, 23 bp, Artificial Sequence
  source: /note="Description of Artificial Sequence: Synthetic oligonucleotide"
aagactgtttgtttaaagactgg

SEQ ID NO: 747 - DNA, 23 bp, Artificial Sequence
  source: /note="Description of Artificial Sequence: Synthetic oligonucleotide"
agactgtttgtttaaagactggg

SEQ ID NO: 748 - DNA, 23 bp, Artificial Sequence
  source: /note="Description of Artificial Sequence: Synthetic oligonucleotide"
actgtttgtttaaagactgggag

SEQ ID NO: 749 - DNA, 23 bp, Artificial Sequence
  source: /note="Description of Artificial Sequence: Synthetic oligonucleotide"
ctgtttgtttaaagactgggagg

SEQ ID NO: 750 - DNA, 23 bp, Artificial Sequence
  source: /note="Description of Artificial Sequence: Synthetic oligonucleotide"
gtttgtttaaagactgggaggag

SEQ ID NO: 751 - DNA, 23 bp, Artificial Sequence
  source: /note="Description of Artificial Sequence: Synthetic oligonucleotide"
gtttaaagactgggaggagttgg

SEQ ID NO: 752 - DNA, 23 bp, Artificial Sequence
  source: /note="Description of Artificial Sequence: Synthetic oligonucleotide"
tttaaagactgggaggagttggg

SEQ ID NO: 753 - DNA, 23 bp, Artificial Sequence
  source: /note="Description of Artificial Sequence: Synthetic oligonucleotide"
ttaaagactgggaggagttgggg

SEQ ID NO: 754 - DNA, 23 bp, Artificial Sequence
  source: /note="Description of Artificial Sequence: Synthetic oligonucleotide"
taaagactgggaggagttggggg

SEQ ID NO: 755 - DNA, 23 bp, Artificial Sequence
  source: /note="Description of Artificial Sequence: Synthetic oligonucleotide"
aagactgggaggagttgggggag

SEQ ID NO: 756 - DNA, 23 bp, Artificial Sequence
  source: /note="Description of Artificial Sequence: Synthetic oligonucleotide"
agactgggaggagttgggggagg

SEQ ID NO: 757 - DNA, 23 bp, Artificial Sequence
  source: /note="Description of Artificial Sequence: Synthetic oligonucleotide"
actgggaggagttgggggaggag

SEQ ID NO: 758 - DNA, 23 bp, Artificial Sequence
  source: /note="Description of Artificial Sequence: Synthetic oligonucleotide"
gaggagttgggggaggagattag

SEQ ID NO: 759 - DNA, 23 bp, Artificial Sequence
  source: /note="Description of Artificial Sequence: Synthetic oligonucleotide"
tgggggaggagattagattaaag

SEQ ID NO: 760 - DNA, 23 bp, Artificial Sequence
  source: /note="Description of Artificial Sequence: Synthetic oligonucleotide"
gggggaggagattagattaaagg

SEQ ID NO: 761 - DNA, 23 bp, Artificial Sequence
  source: /note="Description of Artificial Sequence: Synthetic oligonucleotide"
tagattaaaggtctttgtactag

SEQ ID NO: 762 - DNA, 23 bp, Artificial Sequence
  source: /note="Description of Artificial Sequence: Synthetic oligonucleotide"
agattaaaggtctttgtactagg

SEQ ID NO: 763 - DNA, 23 bp, Artificial Sequence
  source: /note="Description of Artificial Sequence: Synthetic oligonucleotide"
attaaaggtctttgtactaggag

SEQ ID NO: 764 - DNA, 23 bp, Artificial Sequence
  source: /note="Description of Artificial Sequence: Synthetic oligonucleotide"
ttaaaggtctttgtactaggagg

SEQ ID NO: 765 - DNA, 23 bp, Artificial Sequence
  source: /note="Description of Artificial Sequence: Synthetic oligonucleotide"
gtctttgtactaggaggctgtag

SEQ ID NO: 766 - DNA, 23 bp, Artificial Sequence
  source: /note="Description of Artificial Sequence: Synthetic oligonucleotide"
tctttgtactaggaggctgtagg

SEQ ID NO: 767 - DNA, 23 bp, Artificial Sequence
  source: /note="Description of Artificial Sequence: Synthetic oligonucleotide"
aggaggctgtaggcataaattgg

SEQ ID NO: 768 - DNA, 23 bp, Artificial Sequence
  source: /note="Description of Artificial Sequence: Synthetic oligonucleotide"
gcataaattggtctgcgcaccag

SEQ ID NO: 769 - DNA, 23 bp, Artificial Sequence
  source: /note="Description of Artificial Sequence: Synthetic oligonucleotide"
ttgttcatgtcctactgttcaag

SEQ ID NO: 770 - DNA, 23 bp, Artificial Sequence
  source: /note="Description of Artificial Sequence: Synthetic oligonucleotide"
gtcctactgttcaagcctccaag

SEQ ID NO: 771 - DNA, 23 bp, Artificial Sequence
  source: /note="Description of Artificial Sequence: Synthetic oligonucleotide"
caagcctccaagctgtgccttgg

SEQ ID NO: 772 - DNA, 23 bp, Artificial Sequence
  source: /note="Description of Artificial Sequence: Synthetic oligonucleotide"
aagcctccaagctgtgccttggg

SEQ ID NO: 773 - DNA, 23 bp, Artificial Sequence
  source: /note="Description of Artificial Sequence: Synthetic oligonucleotide"
cctccaagctgtgccttgggtgg

SEQ ID NO: 774 - DNA, 23 bp, Artificial Sequence
  source: /note="Description of Artificial Sequence: Synthetic oligonucleotide"
agctgtgccttgggtggctttgg

SEQ ID NO: 775 - DNA, 23 bp, Artificial Sequence
  source: /note="Description of Artificial Sequence: Synthetic oligonucleotide"
gctgtgccttgggtggctttggg

SEQ ID NO: 776 - DNA, 23 bp, Artificial Sequence
  source: /note="Description of Artificial Sequence: Synthetic oligonucleotide"
ctgtgccttgggtggctttgggg

SEQ ID NO: 777 - DNA, 23 bp, Artificial Sequence
  source: /note="Description of Artificial Sequence: Synthetic oligonucleotide"
ccttgggtggctttggggcatgg

SEQ ID NO: 778 - DNA, 23 bp, Artificial Sequence
  source: /note="Description of Artificial Sequence: Synthetic oligonucleotide"
catggacatcgacccttataaag

SEQ ID NO: 779 - DNA, 23 bp, Artificial Sequence
  source: /note="Description of Artificial Sequence: Synthetic oligonucleotide"
atcgacccttataaagaatttgg

SEQ ID NO: 780 - DNA, 23 bp, Artificial Sequence
  source: /note="Description of Artificial Sequence: Synthetic oligonucleotide"
cgacccttataaagaatttggag

SEQ ID NO: 781 - DNA, 23 bp, Artificial Sequence
  source: /note="Description of Artificial Sequence: Synthetic oligonucleotide"
taaagaatttggagctactgtgg

SEQ ID NO: 782 - DNA, 23 bp, Artificial Sequence
  source: /note="Description of Artificial Sequence: Synthetic oligonucleotide"
aagaatttggagctactgtggag

SEQ ID NO: 783 - DNA, 23 bp, Artificial Sequence
  source: /note="Description of Artificial Sequence: Synthetic oligonucleotide"
gccttctgacttctttccttcag

SEQ ID NO: 784 - DNA, 23 bp, Artificial Sequence
  source: /note="Description of Artificial Sequence: Synthetic oligonucleotide"
tgacttctttccttcagtacgag

SEQ ID NO: 785 - DNA, 23 bp, Artificial Sequence
  source: /note="Description of Artificial Sequence: Synthetic oligonucleotide"
tccttcagtacgagatcttctag

SEQ ID NO: 786 - DNA, 23 bp, Artificial Sequence
  source: /note="Description of Artificial Sequence: Synthetic oligonucleotide"
agatcttctagataccgcctcag

SEQ ID NO: 787 - DNA, 23 bp, Artificial Sequence
  source: /note="Description of Artificial Sequence: Synthetic oligonucleotide"
ataccgcctcagctctgtatcgg

SEQ ID NO: 788 - DNA, 23 bp, Artificial Sequence
  source: /note="Description of Artificial Sequence: Synthetic oligonucleotide"
taccgcctcagctctgtatcggg

SEQ ID NO: 789 - DNA, 23 bp, Artificial Sequence
  source: /note="Description of Artificial Sequence: Synthetic oligonucleotide"
cgcctcagctctgtatcgggaag

SEQ ID NO: 790 - DNA, 23 bp, Artificial Sequence
  source: /note="Description of Artificial Sequence: Synthetic oligonucleotide"
agctctgtatcgggaagccttag

SEQ ID NO: 791 - DNA, 23 bp, Artificial Sequence
  source: /note="Description of Artificial Sequence: Synthetic oligonucleotide"
ctctgtatcgggaagccttagag

SEQ ID NO: 792 - DNA, 23 bp, Artificial Sequence
  source: /note="Description of Artificial Sequence: Synthetic oligonucleotide"
gggaagccttagagtctcctgag

SEQ ID NO: 793 - DNA, 23 bp, Artificial Sequence
  source: /note="Description of Artificial Sequence: Synthetic oligonucleotide"
tcacctcaccatactgcactcag

SEQ ID NO: 794 - DNA, 23 bp, Artificial Sequence
  source: /note="Description of Artificial Sequence: Synthetic oligonucleotide"
cacctcaccatactgcactcagg

SEQ ID NO: 795 - DNA, 23 bp, Artificial Sequence
  source: /note="Description of Artificial Sequence: Synthetic oligonucleotide"
tcaccatactgcactcaggcaag

SEQ ID NO: 796 - DNA, 23 bp, Artificial Sequence
  source: /note="Description of Artificial Sequence: Synthetic oligonucleotide"
tcaggcaagcaattctttgctgg

SEQ ID NO: 797 - DNA, 23 bp, Artificial Sequence
  source: /note="Description of Artificial Sequence: Synthetic oligonucleotide"
caggcaagcaattctttgctggg

SEQ ID NO: 798 - DNA, 23 bp, Artificial Sequence
  source: /note="Description of Artificial Sequence: Synthetic oligonucleotide"
aggcaagcaattctttgctgggg

SEQ ID NO: 799 - DNA, 23 bp, Artificial Sequence
  source: /note="Description of Artificial Sequence: Synthetic oligonucleotide"
ggcaagcaattctttgctggggg

SEQ ID NO: 800 - DNA, 23 bp, Artificial Sequence
  source: /note="Description of Artificial Sequence: Synthetic oligonucleotide"
gcaagcaattctttgctgggggg

SEQ ID NO: 801 - DNA, 23 bp, Artificial Sequence
  source: /note="Description of Artificial Sequence: Synthetic oligonucleotide"
ctggggggaactaatgactctag

SEQ ID NO: 802 - DNA, 23 bp, Artificial Sequence
  source: /note="Description of Artificial Sequence: Synthetic oligonucleotide"
aactaatgactctagctacctgg

SEQ ID NO: 803 - DNA, 23 bp, Artificial Sequence
  source: /note="Description of Artificial Sequence: Synthetic oligonucleotide"
actaatgactctagctacctggg

SEQ ID NO: 804 - DNA, 23 bp, Artificial Sequence
  source: /note="Description of Artificial Sequence: Synthetic oligonucleotide"
aatgactctagctacctgggtgg

SEQ ID NO: 805 - DNA, 23 bp, Artificial Sequence
  source: /note="Description of Artificial Sequence: Synthetic oligonucleotide"
atgactctagctacctgggtggg

SEQ ID NO: 806 - DNA, 23 bp, Artificial Sequence
  source: /note="Description of Artificial Sequence: Synthetic oligonucleotide"
tacctgggtgggtgttaatttgg

SEQ ID NO: 807 - DNA, 23 bp, Artificial Sequence
  source: /note="Description of Artificial Sequence: Synthetic oligonucleotide"
ctgggtgggtgttaatttggaag

SEQ ID NO: 808 - DNA, 23 bp, Artificial Sequence
  source: /note="Description of Artificial Sequence: Synthetic oligonucleotide"
gggtgttaatttggaagatccag

SEQ ID NO: 809 - DNA, 23 bp, Artificial Sequence
  source: /note="Description of Artificial Sequence: Synthetic oligonucleotide"
aatttggaagatccagcatctag

SEQ ID NO: 810 - DNA, 23 bp, Artificial Sequence
  source: /note="Description of Artificial Sequence: Synthetic oligonucleotide"
tttggaagatccagcatctagag

SEQ ID NO: 811 - DNA, 23 bp, Artificial Sequence
  source: /note="Description of Artificial Sequence: Synthetic oligonucleotide"
agatccagcatctagagacctag

SEQ ID NO: 812 - DNA, 23 bp, Artificial Sequence
  source: /note="Description of Artificial Sequence: Synthetic oligonucleotide"
tccagcatctagagacctagtag

SEQ ID NO: 813 - DNA, 23 bp, Artificial Sequence
  source: /note="Description of Artificial Sequence: Synthetic oligonucleotide"
gcatctagagacctagtagtcag

SEQ ID NO: 814 - DNA, 23 bp, Artificial Sequence
  source: /note="Description of Artificial Sequence: Synthetic oligonucleotide"
cagttatgtcaacactaatatgg

SEQ ID NO: 815 - DNA, 23 bp, Artificial Sequence
  source: /note="Description of Artificial Sequence: Synthetic oligonucleotide"
agttatgtcaacactaatatggg

SEQ ID NO: 816 - DNA, 23 bp, Artificial Sequence
  source: /note="Description of Artificial Sequence: Synthetic oligonucleotide"
tcaacactaatatgggcctaaag

SEQ ID NO: 817 - DNA, 23 bp, Artificial Sequence
  source: /note="Description of Artificial Sequence: Synthetic oligonucleotide"
actaatatgggcctaaagttcag

SEQ ID NO: 818 - DNA, 23 bp, Artificial Sequence
  source: /note="Description of Artificial Sequence: Synthetic oligonucleotide"
ctaatatgggcctaaagttcagg

SEQ ID NO: 819 - DNA, 23 bp, Artificial Sequence
  source: /note="Description of Artificial Sequence: Synthetic oligonucleotide"
taaagttcaggcaactcttgtgg

SEQ ID NO: 820 - DNA, 23 bp, Artificial Sequence
  source: /note="Description of Artificial Sequence: Synthetic oligonucleotide"
cacatttcttgtctcacttttgg

SEQ ID NO: 821 - DNA, 23 bp, Artificial Sequence
  source: /note="Description of Artificial Sequence: Synthetic oligonucleotide"
atttcttgtctcacttttggaag

SEQ ID NO: 822 - DNA, 23 bp, Artificial Sequence
  source: /note="Description of Artificial Sequence: Synthetic oligonucleotide"
ttcttgtctcacttttggaagag

SEQ ID NO: 823 - DNA, 23 bp, Artificial Sequence
  source: /note="Description of Artificial Sequence: Synthetic oligonucleotide"
ttttggaagagaaaccgttatag

SEQ ID NO: 824 - DNA, 23 bp, Artificial Sequence
  source: /note="Description of Artificial Sequence: Synthetic oligonucleotide"
ttggaagagaaaccgttatagag

SEQ ID NO: 825 - DNA, 23 bp, Artificial Sequence
  source: /note="Description of Artificial Sequence: Synthetic oligonucleotide"
agaaaccgttatagagtatttgg

SEQ ID NO: 826 - DNA, 23 bp, Artificial Sequence
  source: /note="Description of Artificial Sequence: Synthetic oligonucleotide"
atagagtatttggtgtctttcgg

SEQ ID NO: 827 - DNA, 23 bp, Artificial Sequence
  source: /note="Description of Artificial Sequence: Synthetic oligonucleotide"
agagtatttggtgtctttcggag

SEQ ID NO: 828 - DNA, 23 bp, Artificial Sequence
  source: /note="Description of Artificial Sequence: Synthetic oligonucleotide"
atttggtgtctttcggagtgtgg

SEQ ID NO: 829 - DNA, 23 bp, Artificial Sequence
  source: /note="Description of Artificial Sequence: Synthetic oligonucleotide"
agtgtggattcgcactcctccag

SEQ ID NO: 830 - DNA, 23 bp, Artificial Sequence
  source: /note="Description of Artificial Sequence: Synthetic oligonucleotide"
attcgcactcctccagcttatag

SEQ ID NO: 831 - DNA, 23 bp, Artificial Sequence
  source: /note="Description of Artificial Sequence: Synthetic oligonucleotide"
ccctatcctatcaacacttccgg

SEQ ID NO: 832 - DNA, 23 bp, Artificial Sequence
  source: /note="Description of Artificial Sequence: Synthetic oligonucleotide"
cttccggaaactactgttgttag

SEQ ID NO: 833 - DNA, 23 bp, Artificial Sequence
  source: /note="Description of Artificial Sequence: Synthetic oligonucleotide"
aactactgttgttagacgacgag

SEQ ID NO: 834 - DNA, 23 bp, Artificial Sequence
  source: /note="Description of Artificial Sequence: Synthetic oligonucleotide"
actactgttgttagacgacgagg

SEQ ID NO: 835 - DNA, 23 bp, Artificial Sequence
  source: /note="Description of Artificial Sequence: Synthetic oligonucleotide"
actgttgttagacgacgaggcag

SEQ ID NO: 836 - DNA, 23 bp, Artificial Sequence
  source: /note="Description of Artificial Sequence: Synthetic oligonucleotide"
ctgttgttagacgacgaggcagg

SEQ ID NO: 837 - DNA, 23 bp, Artificial Sequence
  source: /note="Description of Artificial Sequence: Synthetic oligonucleotide"
agacgacgaggcaggtcccctag

SEQ ID NO: 838 - DNA, 23 bp, Artificial Sequence
  source: /note="Description of Artificial Sequence: Synthetic oligonucleotide"
cgacgaggcaggtcccctagaag

SEQ ID NO: 839 - DNA, 23 bp, Artificial Sequence
  source: /note="Description of Artificial Sequence: Synthetic oligonucleotide"
cgaggcaggtcccctagaagaag

SEQ ID NO: 840 - DNA, 23 bp, Artificial Sequence
  source: /note="Description of Artificial Sequence: Synthetic oligonucleotide"
agaagaactccctcgcctcgcag

SEQ ID NO: 841 - DNA, 23 bp, Artificial Sequence
  source: /note="Description of Artificial Sequence: Synthetic oligonucleotide"
actccctcgcctcgcagacgaag

SEQ ID NO: 842 - DNA, 23 bp, Artificial Sequence
  source: /note="Description of Artificial Sequence: Synthetic oligonucleotide"
ctccctcgcctcgcagacgaagg

SEQ ID NO: 843 - DNA, 23 bp, Artificial Sequence
  source: /note="Description of Artificial Sequence: Synthetic oligonucleotide"
aggtctcaatcgccgcgtcgcag

SEQ ID NO: 844 - DNA, 23 bp, Artificial Sequence
  source: /note="Description of Artificial Sequence: Synthetic oligonucleotide"
tctcaatcgccgcgtcgcagaag

SEQ ID NO: 845 - DNA, 23 bp, Artificial Sequence
  source: /note="Description of Artificial Sequence: Synthetic oligonucleotide"
gtcgcagaagatctcaatctcgg

SEQ ID NO: 846 - DNA, 23 bp, Artificial Sequence
  source: /note="Description of Artificial Sequence: Synthetic oligonucleotide"
tcgcagaagatctcaatctcggg

SEQ ID NO: 847 - DNA, 23 bp, Artificial Sequence
  source: /note="Description of Artificial Sequence: Synthetic oligonucleotide"
aatctcgggaacctcaatgttag

SEQ ID NO: 848 - DNA, 23 bp, Artificial Sequence
  source: /note="Description of Artificial Sequence: Synthetic oligonucleotide"
acctcaatgttagtattccttgg

SEQ ID NO: 849 - DNA, 23 bp, Artificial Sequence
  source: /note="Description of Artificial Sequence: Synthetic oligonucleotide"
ttagtattccttggactcataag

SEQ ID NO: 850 - DNA, 23 bp, Artificial Sequence
  source: /note="Description of Artificial Sequence: Synthetic oligonucleotide"
tagtattccttggactcataagg

SEQ ID NO: 851 - DNA, 23 bp, Artificial Sequence
  source: /note="Description of Artificial Sequence: Synthetic oligonucleotide"
tattccttggactcataaggtgg

SEQ ID NO: 852 - DNA, 23 bp, Artificial Sequence
  source: /note="Description of Artificial Sequence: Synthetic oligonucleotide"
attccttggactcataaggtggg

SEQ ID NO: 853 - DNA, 23 bp, Artificial Sequence
  source: /note="Description of Artificial Sequence: Synthetic oligonucleotide"
ttccttggactcataaggtgggg

SEQ ID NO: 854 - DNA, 23 bp, Artificial Sequence
  source: /note="Description of Artificial Sequence: Synthetic oligonucleotide"
cataaggtggggaactttactgg

SEQ ID NO: 855 - DNA, 23 bp, Artificial Sequence
  source: /note="Description of Artificial Sequence: Synthetic oligonucleotide"
tacctgtctttaatcctcattgg

SEQ ID NO: 856 - DNA, 23 bp, Artificial Sequence
  source: /note="Description of Artificial Sequence: Synthetic oligonucleotide"
tcctaatatacatttacaccaag

SEQ ID NO: 857 - DNA, 23 bp, Artificial Sequence
  source: /note="Description of Artificial Sequence: Synthetic oligonucleotide"
acattatcaaaaaatgtgaacag

SEQ ID NO: 858 - DNA, 23 bp, Artificial Sequence
  source: /note="Description of Artificial Sequence: Synthetic oligonucleotide"
caaaaaatgtgaacagtttgtag

SEQ ID NO: 859 - DNA, 23 bp, Artificial Sequence
  source: /note="Description of Artificial Sequence: Synthetic oligonucleotide"
aaaaaatgtgaacagtttgtagg

SEQ ID NO: 860 - DNA, 23 bp, Artificial Sequence
  source: /note="Description of Artificial Sequence: Synthetic oligonucleotide"
acagtttgtaggcccacttacag

SEQ ID NO: 861 - DNA, 23 bp, Artificial Sequence
  source: /note="Description of Artificial Sequence: Synthetic oligonucleotide"
taggcccacttacagttaatgag

SEQ ID NO: 862 - DNA, 23 bp, Artificial Sequence
  source: /note="Description of Artificial Sequence: Synthetic oligonucleotide"
ccacttacagttaatgagaaaag

SEQ ID NO: 863 - DNA, 23 bp, Artificial Sequence
  source: /note="Description of Artificial Sequence: Synthetic oligonucleotide"
cttacagttaatgagaaaagaag

SEQ ID NO: 864 - DNA, 23 bp, Artificial Sequence
  source: /note="Description of Artificial Sequence: Synthetic oligonucleotide"
ttgcaattgattatgcctgctag

SEQ ID NO: 865 - DNA, 23 bp, Artificial Sequence
  source: /note="Description of Artificial Sequence: Synthetic oligonucleotide"
tgcaattgattatgcctgctagg

SEQ ID NO: 866 - DNA, 23 bp, Artificial Sequence
  source: /note="Description of Artificial Sequence: Synthetic oligonucleotide"
tgcctgctaggttttatccaaag

SEQ ID NO: 867 - DNA, 23 bp, Artificial Sequence
  source: /note="Description of Artificial Sequence: Synthetic oligonucleotide"
gcctgctaggttttatccaaagg

SEQ ID NO: 868 - DNA, 23 bp, Artificial Sequence
  source: /note="Description of Artificial Sequence: Synthetic oligonucleotide"
ggttaccaaatatttaccattgg

SEQ ID NO: 869 - DNA, 23 bp, Artificial Sequence
  source: /note="Description of Artificial Sequence: Synthetic oligonucleotide"
ccaaatatttaccattggataag

SEQ ID NO: 870 - DNA, 23 bp, Artificial Sequence
  source: /note="Description of Artificial Sequence: Synthetic oligonucleotide"
caaatatttaccattggataagg

SEQ ID NO: 871 - DNA, 23 bp, Artificial Sequence
  source: /note="Description of Artificial Sequence: Synthetic oligonucleotide"
aaatatttaccattggataaggg

SEQ ID NO: 872 - DNA, 23 bp, Artificial Sequence
  source: /note="Description of Artificial Sequence: Synthetic oligonucleotide"
gggtattaaaccttattatccag

SEQ ID NO: 873 - DNA, 23 bp, Artificial Sequence
  source: /note="Description of Artificial Sequence: Synthetic oligonucleotide"
accttattatccagaacatctag

SEQ ID NO: 874 - DNA, 23 bp, Artificial Sequence
  source: /note="Description of Artificial Sequence: Synthetic oligonucleotide"
gttaatcattacttccaaactag

SEQ ID NO: 875 - DNA, 23 bp, Artificial Sequence
  source: /note="Description of Artificial Sequence: Synthetic oligonucleotide"
gacactatttacacactctatgg

SEQ ID NO: 876 - DNA, 23 bp, Artificial Sequence
  source: /note="Description of Artificial Sequence: Synthetic oligonucleotide"
actatttacacactctatggaag

SEQ ID NO: 877 - DNA, 23 bp, Artificial Sequence
  source: /note="Description of Artificial Sequence: Synthetic oligonucleotide"
ctatttacacactctatggaagg

SEQ ID NO: 878 - DNA, 23 bp, Artificial Sequence
  source: /note="Description of Artificial Sequence: Synthetic oligonucleotide"
tttacacactctatggaaggcgg

SEQ ID NO: 879 - DNA, 23 bp, Artificial Sequence
  source: /note="Description of Artificial Sequence: Synthetic oligonucleotide"
ttacacactctatggaaggcggg

SEQ ID NO: 880 - DNA, 23 bp, Artificial Sequence
  source: /note="Description of Artificial Sequence: Synthetic oligonucleotide"
ggaaggcgggtatattatataag

SEQ ID NO: 881 - DNA, 23 bp, Artificial Sequence
  source: /note="Description of Artificial Sequence: Synthetic oligonucleotide"
aaggcgggtatattatataagag

SEQ ID NO: 882 - DNA, 23 bp, Artificial Sequence
  source: /note="Description of Artificial Sequence: Synthetic oligonucleotide"
ggcgggtatattatataagagag

SEQ ID NO: 883 - DNA, 23 bp, Artificial Sequence
  source: /note="Description of Artificial Sequence: Synthetic oligonucleotide"
tataagagagaaacaacacatag

SEQ ID NO: 884 - DNA, 23 bp, Artificial Sequence
  source: /note="Description of Artificial Sequence: Synthetic oligonucleotide"
acacatagcgcctcattttgtgg

SEQ ID NO: 885 - DNA, 23 bp, Artificial Sequence
  source: /note="Description of Artificial Sequence: Synthetic oligonucleotide"
cacatagcgcctcattttgtggg

SEQ ID NO: 886 - DNA, 23 bp, Artificial Sequence
  source: /note="Description of Artificial Sequence: Synthetic oligonucleotide"
tttgtgggtcaccatattcttgg

SEQ ID NO: 887 - DNA, 23 bp, Artificial Sequence
  source: /note="Description of Artificial Sequence: Synthetic oligonucleotide"
ttgtgggtcaccatattcttggg

SEQ ID NO: 888 - DNA, 23 bp, Artificial Sequence
  source: /note="Description of Artificial Sequence: Synthetic oligonucleotide"
gtcaccatattcttgggaacaag

SEQ ID NO: 889 - DNA, 23 bp, Artificial Sequence
  source: /note="Description of Artificial Sequence: Synthetic oligonucleotide"
attcttgggaacaagatctacag

SEQ ID NO: 890 - DNA, 23 bp, Artificial Sequence
  source: /note="Description of Artificial Sequence: Synthetic oligonucleotide"
tgggaacaagatctacagcatgg

SEQ ID NO: 891 - DNA, 23 bp, Artificial Sequence
  source: /note="Description of Artificial Sequence: Synthetic oligonucleotide"
gggaacaagatctacagcatggg

SEQ ID NO: 892 - DNA, 23 bp, Artificial Sequence
  source: /note="Description of Artificial Sequence: Synthetic oligonucleotide"
ggaacaagatctacagcatgggg

SEQ ID NO: 893 - DNA, 23 bp, Artificial Sequence
  source: /note="Description of Artificial Sequence: Synthetic oligonucleotide"
acaagatctacagcatggggcag

SEQ ID NO: 894 - DNA, 23 bp, Artificial Sequence
  source: /note="Description of Artificial Sequence: Synthetic oligonucleotide"
atggggcagaatctttccaccag

SEQ ID NO: 895 - DNA, 23 bp, Artificial Sequence
  source: /note="Description of Artificial Sequence: Synthetic oligonucleotide"
tctttccaccagcaatcctctgg

SEQ ID NO: 896 - DNA, 23 bp, Artificial Sequence
  source: /note="Description of Artificial Sequence: Synthetic oligonucleotide"
ctttccaccagcaatcctctggg

SEQ ID NO: 897 - DNA, 23 bp, Artificial Sequence
  source: /note="Description of Artificial Sequence: Synthetic oligonucleotide"
tgggattctttcccgaccaccag

SEQ ID NO: 898 - DNA, 23 bp, Artificial Sequence
  source: /note="Description of Artificial Sequence: Synthetic oligonucleotide"
attctttcccgaccaccagttgg

SEQ ID NO: 899 - DNA, 23 bp, Artificial Sequence
  source: /note="Description of Artificial Sequence: Synthetic oligonucleotide"
tcccgaccaccagttggatccag

SEQ ID NO: 900 - DNA, 23 bp, Artificial Sequence
  source: /note="Description of Artificial Sequence: Synthetic oligonucleotide"
caccagttggatccagccttcag

SEQ ID NO: 901 - DNA, 23 bp, Artificial Sequence
  source: /note="Description of Artificial Sequence: Synthetic oligonucleotide"
ccagttggatccagccttcagag

SEQ ID NO: 902 - DNA, 23 bp, Artificial Sequence
  source: /note="Description of Artificial Sequence: Synthetic oligonucleotide"
tccagccttcagagcaaacacag

SEQ ID NO: 903 - DNA, 23 bp, Artificial Sequence
  source: /note="Description of Artificial Sequence: Synthetic oligonucleotide"
cagagcaaacacagcaaatccag

SEQ ID NO: 904 - DNA, 23 bp, Artificial Sequence
  source: /note="Description of Artificial Sequence: Synthetic oligonucleotide"
caaacacagcaaatccagattgg

SEQ ID NO: 905 - DNA, 23 bp, Artificial Sequence
  source: /note="Description of Artificial Sequence: Synthetic oligonucleotide"
aaacacagcaaatccagattggg

SEQ ID NO: 906 - DNA, 23 bp, Artificial Sequence
  source: /note="Description of Artificial Sequence: Synthetic oligonucleotide"
attgggacttcaatcccaacaag

SEQ ID NO: 907 - DNA, 23 bp, Artificial Sequence
  source: /note="Description of Artificial Sequence: Synthetic oligonucleotide"
ttgggacttcaatcccaacaagg

SEQ ID NO: 908 - DNA, 23 bp, Artificial Sequence
  source: /note="Description of Artificial Sequence: Synthetic oligonucleotide"
tcaatcccaacaaggacacctgg

SEQ ID NO: 909 - DNA, 23 bp, Artificial Sequence
  source: /note="Description of Artificial Sequence: Synthetic oligonucleotide"
tcccaacaaggacacctggccag

SEQ ID NO: 910 - DNA, 23 bp, Artificial Sequence
  source: /note="Description of Artificial Sequence: Synthetic oligonucleotide"
acacctggccagacgccaacaag

SEQ ID NO: 911 - DNA, 23 bp, Artificial Sequence
  source: /note="Description of Artificial Sequence: Synthetic oligonucleotide"
cacctggccagacgccaacaagg

SEQ ID NO: 912 - DNA, 23 bp, Artificial Sequence
  source: /note="Description of Artificial Sequence: Synthetic oligonucleotide"
ctggccagacgccaacaaggtag

SEQ ID NO: 913 - DNA, 23 bp, Artificial Sequence
  source: /note="Description of Artificial Sequence: Synthetic oligonucleotide"
tggccagacgccaacaaggtagg

SEQ ID NO: 914 - DNA, 23 bp, Artificial Sequence
  source: /note="Description of Artificial Sequence: Synthetic oligonucleotide"
gccagacgccaacaaggtaggag

SEQ ID NO: 915 - DNA, 23 bp, Artificial Sequence
  source: /note="Description of Artificial Sequence: Synthetic oligonucleotide"
gacgccaacaaggtaggagctgg

SEQ ID NO: 916 - DNA, 23 bp, Artificial Sequence
  source: /note="Description of Artificial Sequence: Synthetic oligonucleotide"
cgccaacaaggtaggagctggag

SEQ ID NO: 917 - DNA, 23 bp, Artificial Sequence
  source: /note="Description of Artificial Sequence: Synthetic oligonucleotide"
aaggtaggagctggagcattcgg

SEQ ID NO: 918 - DNA, 23 bp, Artificial Sequence
  source: /note="Description of Artificial Sequence: Synthetic oligonucleotide"
aggtaggagctggagcattcggg

SEQ ID NO: 919 - DNA, 23 bp, Artificial Sequence
  source: /note="Description of Artificial Sequence: Synthetic oligonucleotide"
aggagctggagcattcgggctgg

SEQ ID NO: 920 - DNA, 23 bp, Artificial Sequence
  source: /note="Description of Artificial Sequence: Synthetic oligonucleotide"
ggagctggagcattcgggctggg

SEQ ID NO: 921 - DNA, 23 bp, Artificial Sequence
  source: /note="Description of Artificial Sequence: Synthetic oligonucleotide"
ctgggtttcaccccaccgcacgg

SEQ ID NO: 922 - DNA, 23 bp, Artificial Sequence
  source: /note="Description of Artificial Sequence: Synthetic oligonucleotide"
gggtttcaccccaccgcacggag

SEQ ID NO: 923 - DNA, 23 bp, Artificial Sequence
  source: /note="Description of Artificial Sequence: Synthetic oligonucleotide"
ggtttcaccccaccgcacggagg

SEQ ID NO: 924 - DNA, 23 bp, Artificial Sequence
  source: /note="Description of Artificial Sequence: Synthetic oligonucleotide"
cccaccgcacggaggccttttgg

SEQ ID NO: 925 - DNA, 23 bp, Artificial Sequence
  source: /note="Description of Artificial Sequence: Synthetic oligonucleotide"
ccaccgcacggaggccttttggg

SEQ ID NO: 926 - DNA, 23 bp, Artificial Sequence
  source: /note="Description of Artificial Sequence: Synthetic oligonucleotide"
caccgcacggaggccttttgggg

SEQ ID NO: 927 - DNA, 23 bp, Artificial Sequence
  source: /note="Description of Artificial Sequence: Synthetic oligonucleotide"
cgcacggaggccttttggggtgg

SEQ ID NO: 928 - DNA, 23 bp, Artificial Sequence
  source: /note="Description of Artificial Sequence: Synthetic oligonucleotide"
cacggaggccttttggggtggag

SEQ ID NO: 929 - DNA, 23 bp, Artificial Sequence
  source: /note="Description of Artificial Sequence: Synthetic oligonucleotide"
gccttttggggtggagccctcag

SEQ ID NO: 930 - DNA, 23 bp, Artificial Sequence
  source: /note="Description of Artificial Sequence: Synthetic oligonucleotide"
ccttttggggtggagccctcagg

SEQ ID NO: 931 - DNA, 23 bp, Artificial Sequence
  source: /note="Description of Artificial Sequence: Synthetic oligonucleotide"
tggggtggagccctcaggctcag

SEQ ID NO: 932 - DNA, 23 bp, Artificial Sequence
  source: /note="Description of Artificial Sequence: Synthetic oligonucleotide"
ggggtggagccctcaggctcagg

SEQ ID NO: 933 - DNA, 23 bp, Artificial Sequence
  source: /note="Description of Artificial Sequence: Synthetic oligonucleotide"
gggtggagccctcaggctcaggg

SEQ ID NO: 934 - DNA, 23 bp, Artificial Sequence
  source: /note="Description of Artificial Sequence: Synthetic oligonucleotide"
gggcatactacaaactttgccag

SEQ ID NO: 935 - DNA, 23 bp, Artificial Sequence
  source: /note="Description of Artificial Sequence: Synthetic oligonucleotide"
ctcctgcctccaccaatcgccag

SEQ ID NO: 936 - DNA, 23 bp, Artificial Sequence
  source: /note="Description of Artificial Sequence: Synthetic oligonucleotide"
tgcctccaccaatcgccagacag

SEQ ID NO: 937 - DNA, 23 bp, Artificial Sequence
  source: /note="Description of Artificial Sequence: Synthetic oligonucleotide"
gcctccaccaatcgccagacagg

SEQ ID NO: 938 - DNA, 23 bp, Artificial Sequence
  source: /note="Description of Artificial Sequence: Synthetic oligonucleotide"
tccaccaatcgccagacaggaag

SEQ ID NO: 939 - DNA, 23 bp, Artificial Sequence
  source: /note="Description of Artificial Sequence: Synthetic oligonucleotide"
ccaccaatcgccagacaggaagg

SEQ ID NO: 940 - DNA, 23 bp, Artificial Sequence
  source: /note="Description of Artificial Sequence: Synthetic oligonucleotide"
ccaatcgccagacaggaaggcag

SEQ ID NO: 941 - DNA, 23 bp, Artificial Sequence
  source: /note="Description of Artificial Sequence: Synthetic oligonucleotide"
accccgctgtctccacctttgag

SEQ ID NO: 942 - DNA, 23 bp, Artificial Sequence
  source: /note="Description of Artificial Sequence: Synthetic oligonucleotide"
ctttgagaaacactcatcctcag

SEQ ID NO: 943 - DNA, 23 bp, Artificial Sequence
  source: /note="Description of Artificial Sequence: Synthetic oligonucleotide"
tttgagaaacactcatcctcagg

SEQ ID NO: 944 - DNA, 23 bp, Artificial Sequence
  source: /note="Description of Artificial Sequence: Synthetic oligonucleotide"
acactcatcctcaggccatgcag

SEQ ID NO: 945 - DNA, 23 bp, Artificial Sequence
  source: /note="Description of Artificial Sequence: Synthetic oligonucleotide"
ctcatcctcaggccatgcagtgg

SEQ ID NO: 946 - DNA, 11 bp, Artificial Sequence
  source: /note="Description of Artificial Sequence: Synthetic oligonucleotide"
ttgtggaattc

SEQ ID NO: 947 - DNA, 17 bp, Artificial Sequence
  source: /note="Description of Artificial Sequence: Synthetic oligonucleotide"
gaaaggttgtggaattc

SEQ ID NO: 948 - DNA, 18 bp, Artificial Sequence
  source: /note="Description of Artificial Sequence: Synthetic oligonucleotide"
tgaaaggttgtggaattg

SEQ ID NO: 949 - DNA, 23 bp, Artificial Sequence
  source: /note="Description of Artificial Sequence: Synthetic oligonucleotide"
ccactgcatggcctgaggatgag

SEQ ID NO: 950 - DNA, 23 bp, Artificial Sequence
  source: /note="Description of Artificial Sequence: Synthetic oligonucleotide"
ctgaggatgagtgtttctcaaag

SEQ ID NO: 951 - DNA, 23 bp, Artificial Sequence
  source: /note="Description of Artificial Sequence: Synthetic oligonucleotide"
tgaggatgagtgtttctcaaagg

SEQ ID NO: 952 - DNA, 23 bp, Artificial Sequence
  source: /note="Description of Artificial Sequence: Synthetic oligonucleotide"
ggatgagtgtttctcaaaggtgg

SEQ ID NO: 953 - DNA, 23 bp, Artificial Sequence
  source: /note="Description of Artificial Sequence: Synthetic oligonucleotide"
atgagtgtttctcaaaggtggag

SEQ ID NO: 954 - DNA, 23 bp, Artificial Sequence
  source: /note="Description of Artificial Sequence: Synthetic oligonucleotide"
gtgtttctcaaaggtggagacag

SEQ ID NO: 955 - DNA, 23 bp, Artificial Sequence
  source: /note="Description of Artificial Sequence: Synthetic oligonucleotide"
tttctcaaaggtggagacagcgg

SEQ ID NO: 956 - DNA, 23 bp, Artificial Sequence
  source: /note="Description of Artificial Sequence: Synthetic oligonucleotide"
ttctcaaaggtggagacagcggg

SEQ ID NO: 957 - DNA, 23 bp, Artificial Sequence
  source: /note="Description of Artificial Sequence: Synthetic oligonucleotide"
tctcaaaggtggagacagcgggg

SEQ ID NO: 958 - DNA, 23 bp, Artificial Sequence
  source: /note="Description of Artificial Sequence: Synthetic oligonucleotide"
caaaggtggagacagcggggtag

SEQ ID NO: 959 - DNA, 23 bp, Artificial Sequence
  source: /note="Description of Artificial Sequence: Synthetic oligonucleotide"
aaaggtggagacagcggggtagg

SEQ ID NO: 960 - DNA, 23 bp, Artificial Sequence
  source: /note="Description of Artificial Sequence: Synthetic oligonucleotide"
gggtaggctgccttcctgtctgg

SEQ ID NO: 961 - DNA, 23 bp, Artificial Sequence
  source: /note="Description of Artificial Sequence: Synthetic oligonucleotide"
ctgccttcctgtctggcgattgg

SEQ ID NO: 962 - DNA, 23 bp, Artificial Sequence
  source: /note="Description of Artificial Sequence: Synthetic oligonucleotide"
ccttcctgtctggcgattggtgg

SEQ ID NO: 963 - DNA, 23 bp, Artificial Sequence
  source: /note="Description of Artificial Sequence: Synthetic oligonucleotide"
ttcctgtctggcgattggtggag

SEQ ID NO: 964 - DNA, 23 bp, Artificial Sequence
  source: /note="Description of Artificial Sequence: Synthetic oligonucleotide"
tcctgtctggcgattggtggagg

SEQ ID NO: 965 - DNA, 23 bp, Artificial Sequence
  source: /note="Description of Artificial Sequence: Synthetic oligonucleotide"
tgtctggcgattggtggaggcag

SEQ ID NO: 966 - DNA, 23 bp, Artificial Sequence
  source: /note="Description of Artificial Sequence: Synthetic oligonucleotide"
gtctggcgattggtggaggcagg

SEQ ID NO: 967 - DNA, 23 bp, Artificial Sequence
  source: /note="Description of Artificial Sequence: Synthetic oligonucleotide"
ctggcgattggtggaggcaggag

SEQ ID NO: 968 - DNA, 23 bp, Artificial Sequence
  source: /note="Description of Artificial Sequence: Synthetic oligonucleotide"
tggcgattggtggaggcaggagg

SEQ ID NO: 969 - DNA, 23 bp, Artificial Sequence
  source: /note="Description of Artificial Sequence: Synthetic oligonucleotide"
cgattggtggaggcaggaggcgg

SEQ ID NO: 970 - DNA, 23 bp, Artificial Sequence
  source: /note="Description of Artificial Sequence: Synthetic oligonucleotide"
gaggcaggaggcggatttgctgg

SEQ ID NO: 971 - DNA, 23 bp, Artificial Sequence
  source: /note="Description of Artificial Sequence: Synthetic oligonucleotide"
aggaggcggatttgctggcaaag

SEQ ID NO: 972 - DNA, 23 bp, Artificial Sequence
  source: /note="Description of Artificial Sequence: Synthetic oligonucleotide"
ggatttgctggcaaagtttgtag

SEQ ID NO: 973 - DNA, 23 bp, Artificial Sequence
  source: /note="Description of Artificial Sequence: Synthetic oligonucleotide"
caaagtttgtagtatgccctgag

SEQ ID NO: 974 - DNA, 23 bp, Artificial Sequence
  source: /note="Description of Artificial Sequence: Synthetic oligonucleotide"
ttgtagtatgccctgagcctgag

SEQ ID NO: 975 - DNA, 23 bp, Artificial Sequence
  source: /note="Description of Artificial Sequence: Synthetic oligonucleotide"
tgtagtatgccctgagcctgagg

SEQ ID NO: 976 - DNA, 23 bp, Artificial Sequence
  source: /note="Description of Artificial Sequence: Synthetic oligonucleotide"
gtagtatgccctgagcctgaggg

SEQ ID NO: 977 - DNA, 23 bp, Artificial Sequence
  source: /note="Description of Artificial Sequence: Synthetic oligonucleotide"
gcctgagggctccaccccaaaag

SEQ ID NO: 978 - DNA, 23 bp, Artificial Sequence
  source: /note="Description of Artificial Sequence: Synthetic oligonucleotide"
cctgagggctccaccccaaaagg

SEQ ID NO: 979 - DNA, 23 bp, Artificial Sequence
  source: /note="Description of Artificial Sequence: Synthetic oligonucleotide"
caccccaaaaggcctccgtgcgg

SEQ ID NO: 980 - DNA, 23 bp, Artificial Sequence
  source: /note="Description of Artificial Sequence: Synthetic oligonucleotide"
cccaaaaggcctccgtgcggtgg

SEQ ID NO: 981 - DNA, 23 bp, Artificial Sequence
  source: /note="Description of Artificial Sequence: Synthetic oligonucleotide"
ccaaaaggcctccgtgcggtggg

SEQ ID NO: 982 - DNA, 23 bp, Artificial Sequence
  source: /note="Description of Artificial Sequence: Synthetic oligonucleotide"
caaaaggcctccgtgcggtgggg

SEQ ID NO: 983 - DNA, 23 bp, Artificial Sequence
  source: /note="Description of Artificial Sequence: Synthetic oligonucleotide"
ccgtgcggtggggtgaaacccag

SEQ ID NO: 984 - DNA, 23 bp, Artificial Sequence
  source: /note="Description of Artificial Sequence: Synthetic oligonucleotide"
gaaacccagcccgaatgctccag

SEQ ID NO: 985 - DNA, 23 bp, Artificial Sequence
  source: /note="Description of Artificial Sequence: Synthetic oligonucleotide"
tgctccagctcctaccttgttgg

SEQ ID NO: 986 - DNA, 23 bp, Artificial Sequence
  source: /note="Description of Artificial Sequence: Synthetic oligonucleotide"
gctcctaccttgttggcgtctgg

SEQ ID NO: 987 - DNA, 23 bp, Artificial Sequence
  source: /note="Description of Artificial Sequence: Synthetic oligonucleotide"
ctaccttgttggcgtctggccag

SEQ ID NO: 988 - DNA, 23 bp, Artificial Sequence
  source: /note="Description of Artificial Sequence: Synthetic oligonucleotide"
taccttgttggcgtctggccagg

SEQ ID NO: 989 - DNA, 23 bp, Artificial Sequence
  source: /note="Description of Artificial Sequence: Synthetic oligonucleotide"
gtctggccaggtgtccttgttgg

SEQ ID NO: 990 - DNA, 23 bp, Artificial Sequence
  source: /note="Description of Artificial Sequence: Synthetic oligonucleotide"
tctggccaggtgtccttgttggg

SEQ ID NO: 991 - DNA, 23 bp, Artificial Sequence
  source: /note="Description of Artificial Sequence: Synthetic oligonucleotide"
aggtgtccttgttgggattgaag

SEQ ID NO: 992 - DNA, 23 bp, Artificial Sequence
  source: /note="Description of Artificial Sequence: Synthetic oligonucleotide"
ttgggattgaagtcccaatctgg

SEQ ID NO: 993 - DNA, 23 bp, Artificial Sequence
  source: /note="Description of Artificial Sequence: Synthetic oligonucleotide"
gatttgctgtgtttgctctgaag

SEQ ID NO: 994 - DNA, 23 bp, Artificial Sequence
  source: /note="Description of Artificial Sequence: Synthetic oligonucleotide"
atttgctgtgtttgctctgaagg

SEQ ID NO: 995 - DNA, 23 bp, Artificial Sequence
  source: /note="Description of Artificial Sequence: Synthetic oligonucleotide"
gctgtgtttgctctgaaggctgg

SEQ ID NO: 996 - DNA, 23 bp, Artificial Sequence
  source: /note="Description of Artificial Sequence: Synthetic oligonucleotide"
ctctgaaggctggatccaactgg

SEQ ID NO: 997 - DNA, 23 bp, Artificial Sequence
  source: /note="Description of Artificial Sequence: Synthetic oligonucleotide"
tgaaggctggatccaactggtgg

SEQ ID NO: 998 - DNA, 23 bp, Artificial Sequence
  source: /note="Description of Artificial Sequence: Synthetic oligonucleotide"
ggctggatccaactggtggtcgg

SEQ ID NO: 999 - DNA, 23 bp, Artificial Sequence
  source: /note="Description of Artificial Sequence: Synthetic oligonucleotide"
gctggatccaactggtggtcggg

SEQ ID NO: 1000 - DNA, 23 bp, Artificial Sequence
  source: /note="Description of Artificial Sequence: Synthetic oligonucleotide"
gatccaactggtggtcgggaaag

SEQ ID NO: 1001 - DNA, 23 bp, Artificial Sequence
  source: /note="Description of Artificial Sequence: Synthetic oligonucleotide"
tggtggtcgggaaagaatcccag

SEQ ID NO: 1002 - DNA, 23 bp, Artificial Sequence
  source: /note="Description of Artificial Sequence: Synthetic oligonucleotide"
gtggtcgggaaagaatcccagag

SEQ ID NO: 1003 - DNA, 23 bp, Artificial Sequence
  source: /note="Description of Artificial Sequence: Synthetic oligonucleotide"
tggtcgggaaagaatcccagagg

SEQ ID NO: 1004 - DNA, 23 bp, Artificial Sequence
  source: /note="Description of Artificial Sequence: Synthetic oligonucleotide"
aaagaatcccagaggattgctgg

SEQ ID NO: 1005 - DNA, 23 bp, Artificial Sequence
  source: /note="Description of Artificial Sequence: Synthetic oligonucleotide"
gaatcccagaggattgctggtgg

SEQ ID NO: 1006 - DNA, 23 bp, Artificial Sequence
  source: /note="Description of Artificial Sequence: Synthetic oligonucleotide"
cccagaggattgctggtggaaag

SEQ ID NO: 1007 - DNA, 23 bp, Artificial Sequence
  source: /note="Description of Artificial Sequence: Synthetic oligonucleotide"
aaagattctgccccatgctgtag

SEQ ID NO: 1008 - DNA, 23 bp, Artificial Sequence
  source: /note="Description of Artificial Sequence: Synthetic oligonucleotide"
atgctgtagatcttgttcccaag

SEQ ID NO: 1009 - DNA, 23 bp, Artificial Sequence
  source: /note="Description of Artificial Sequence: Synthetic oligonucleotide"
agatcttgttcccaagaatatgg

SEQ ID NO: 1010 - DNA, 23 bp, Artificial Sequence
  source: /note="Description of Artificial Sequence: Synthetic oligonucleotide"
aatatggtgacccacaaaatgag

SEQ ID NO: 1011 - DNA, 23 bp, Artificial Sequence
  source: /note="Description of Artificial Sequence: Synthetic oligonucleotide"
atatggtgacccacaaaatgagg

SEQ ID NO: 1012 - DNA, 23 bp, Artificial Sequence
  source: /note="Description of Artificial Sequence: Synthetic oligonucleotide"
tataatatacccgccttccatag

SEQ ID NO: 1013 - DNA, 23 bp, Artificial Sequence
  source: /note="Description of Artificial Sequence: Synthetic oligonucleotide"
taatatacccgccttccatagag

SEQ ID NO: 1014 - DNA, 23 bp, Artificial Sequence
  source: /note="Description of Artificial Sequence: Synthetic oligonucleotide"
ccttccatagagtgtgtaaatag

SEQ ID NO: 1015 - DNA, 23 bp, Artificial Sequence
  source: /note="Description of Artificial Sequence: Synthetic oligonucleotide"
tagagtgtgtaaatagtgtctag

SEQ ID NO: 1016 - DNA, 23 bp, Artificial Sequence
  source: /note="Description of Artificial Sequence: Synthetic oligonucleotide"
tgtgtaaatagtgtctagtttgg

SEQ ID NO: 1017 - DNA, 23 bp, Artificial Sequence
  source: /note="Description of Artificial Sequence: Synthetic oligonucleotide"
gtaaatagtgtctagtttggaag

SEQ ID NO: 1018 - DNA, 23 bp, Artificial Sequence
  source: /note="Description of Artificial Sequence: Synthetic oligonucleotide"
gtttggaagtaatgattaactag

SEQ ID NO: 1019 - DNA, 23 bp, Artificial Sequence
  source: /note="Description of Artificial Sequence: Synthetic oligonucleotide"
taatgattaactagatgttctgg

SEQ ID NO: 1020 - DNA, 23 bp, Artificial Sequence
  source: /note="Description of Artificial Sequence: Synthetic oligonucleotide"
aactagatgttctggataataag

SEQ ID NO: 1021 - DNA, 23 bp, Artificial Sequence
  source: /note="Description of Artificial Sequence: Synthetic oligonucleotide"
actagatgttctggataataagg

SEQ ID NO: 1022 - DNA, 23 bp, Artificial Sequence
  source: /note="Description of Artificial Sequence: Synthetic oligonucleotide"
ggtttaatacccttatccaatgg

SEQ ID NO: 1023 - DNA, 23 bp, Artificial Sequence
  source: /note="Description of Artificial Sequence: Synthetic oligonucleotide"
cttatccaatggtaaatatttgg

SEQ ID NO: 1024 - DNA, 23 bp, Artificial Sequence
  source: /note="Description of Artificial Sequence: Synthetic oligonucleotide"
ggtaaatatttggtaacctttgg

SEQ ID NO: 1025 - DNA, 23 bp, Artificial Sequence
  source: /note="Description of Artificial Sequence: Synthetic oligonucleotide"
ggtaacctttggataaaacctag

SEQ ID NO: 1026 - DNA, 23 bp, Artificial Sequence
  source: /note="Description of Artificial Sequence: Synthetic oligonucleotide"
aacctttggataaaacctagcag

SEQ ID NO: 1027 - DNA, 23 bp, Artificial Sequence
  source: /note="Description of Artificial Sequence: Synthetic oligonucleotide"
acctttggataaaacctagcagg

SEQ ID NO: 1028 - DNA, 23 bp, Artificial Sequence
  source: /note="Description of Artificial Sequence: Synthetic oligonucleotide"
cttcttttctcattaactgtaag

SEQ ID NO: 1029 - DNA, 23 bp, Artificial Sequence
  source: /note="Description of Artificial Sequence: Synthetic oligonucleotide"
cttttctcattaactgtaagtgg

SEQ ID NO: 1030 - DNA, 23 bp, Artificial Sequence
  source: /note="Description of Artificial Sequence: Synthetic oligonucleotide"
ttttctcattaactgtaagtggg

SEQ ID NO: 1031 - DNA, 23 bp, Artificial Sequence
  source: /note="Description of Artificial Sequence: Synthetic oligonucleotide"
cacattttttgataatgtcttgg

SEQ ID NO: 1032 - DNA, 23 bp, Artificial Sequence
  source: /note="Description of Artificial Sequence: Synthetic oligonucleotide"
gtcttggtgtaaatgtatattag

SEQ ID NO: 1033 - DNA, 23 bp, Artificial Sequence
  source: /note="Description of Artificial Sequence: Synthetic oligonucleotide"
tcttggtgtaaatgtatattagg

SEQ ID NO: 1034 - DNA, 23 bp, Artificial Sequence
  source: /note="Description of Artificial Sequence: Synthetic oligonucleotide"
gtgtaaatgtatattaggaaaag

SEQ ID NO: 1035 - DNA, 23 bp, Artificial Sequence
  source: /note="Description of Artificial Sequence: Synthetic oligonucleotide"
aaatgtatattaggaaaagatgg

SEQ ID NO: 1036 - DNA, 23 bp, Artificial Sequence
  source: /note="Description of Artificial Sequence: Synthetic oligonucleotide"
aaaagatggtgttttccaatgag

SEQ ID NO: 1037 - DNA, 23 bp, Artificial Sequence
  source: /note="Description of Artificial Sequence: Synthetic oligonucleotide"
aaagatggtgttttccaatgagg

SEQ ID NO: 1038 - DNA, 23 bp, Artificial Sequence
  source: /note="Description of Artificial Sequence: Synthetic oligonucleotide"
gtgttttccaatgaggattaaag

SEQ ID NO: 1039 - DNA, 23 bp, Artificial Sequence
  source: /note="Description of Artificial Sequence: Synthetic oligonucleotide"
tttccaatgaggattaaagacag

SEQ ID NO: 1040 - DNA, 23 bp, Artificial Sequence
  source: /note="Description of Artificial Sequence: Synthetic oligonucleotide"
ttccaatgaggattaaagacagg

SEQ ID NO: 1041 - DNA, 23 bp, Artificial Sequence
  source: /note="Description of Artificial Sequence: Synthetic oligonucleotide"
atgaggattaaagacaggtacag

SEQ ID NO: 1042 - DNA, 23 bp, Artificial Sequence
  source: /note="Description of Artificial Sequence: Synthetic oligonucleotide"
aggattaaagacaggtacagtag

SEQ ID NO: 1043 - DNA, 23 bp, Artificial Sequence
  source: /note="Description of Artificial Sequence: Synthetic oligonucleotide"
attaaagacaggtacagtagaag

SEQ ID NO: 1044 - DNA, 23 bp, Artificial Sequence
  source: /note="Description of Artificial Sequence: Synthetic oligonucleotide"
acaggtacagtagaagaataaag

SEQ ID NO: 1045 - DNA, 23 bp, Artificial Sequence
  source: /note="Description of Artificial Sequence: Synthetic oligonucleotide"
tacagtagaagaataaagaccag

SEQ ID NO: 1046 - DNA, 23 bp, Artificial Sequence
  source: /note="Description of Artificial Sequence: Synthetic oligonucleotide"
tagaagaataaagaccagtaaag

SEQ ID NO: 1047 - DNA, 23 bp, Artificial Sequence
  source: /note="Description of Artificial Sequence: Synthetic oligonucleotide"
agtaaagttccccaccttatgag

SEQ ID NO: 1048 - DNA, 23 bp, Artificial Sequence
  source: /note="Description of Artificial Sequence: Synthetic oligonucleotide"
gttccccaccttatgagtccaag

SEQ ID NO: 1049 - DNA, 23 bp, Artificial Sequence
  source: /note="Description of Artificial Sequence: Synthetic oligonucleotide"
ttccccaccttatgagtccaagg

SEQ ID NO: 1050 - DNA, 23 bp, Artificial Sequence
  source: /note="Description of Artificial Sequence: Synthetic oligonucleotide"
gtccaaggaatactaacattgag

SEQ ID NO: 1051 - DNA, 23 bp, Artificial Sequence
  source: /note="Description of Artificial Sequence: Synthetic oligonucleotide"
tccaaggaatactaacattgagg

SEQ ID NO: 1052 - DNA, 23 bp, Artificial Sequence
  source: /note="Description of Artificial Sequence: Synthetic oligonucleotide"
atactaacattgaggttcccgag

SEQ ID NO: 1053 - DNA, 23 bp, Artificial Sequence
  source: /note="Description of Artificial Sequence: Synthetic oligonucleotide"
acattgaggttcccgagattgag

SEQ ID NO: 1054 - DNA, 23 bp, Artificial Sequence
  source: /note="Description of Artificial Sequence: Synthetic oligonucleotide"
gattgagatcttctgcgacgcgg

SEQ ID NO: 1055 - DNA, 23 bp, Artificial Sequence
  source: /note="Description of Artificial Sequence: Synthetic oligonucleotide"
tcttctgcgacgcggcgattgag

SEQ ID NO: 1056 - DNA, 23 bp, Artificial Sequence
  source: /note="Description of Artificial Sequence: Synthetic oligonucleotide"
cgattgagaccttcgtctgcgag

SEQ ID NO: 1057 - DNA, 23 bp, Artificial Sequence
  source: /note="Description of Artificial Sequence: Synthetic oligonucleotide"
gattgagaccttcgtctgcgagg

SEQ ID NO: 1058 - DNA, 23 bp, Artificial Sequence
  source: /note="Description of Artificial Sequence: Synthetic oligonucleotide"
gagaccttcgtctgcgaggcgag

SEQ ID NO: 1059 - DNA, 23 bp, Artificial Sequence
  source: /note="Description of Artificial Sequence: Synthetic oligonucleotide"
agaccttcgtctgcgaggcgagg

SEQ ID NO: 1060 - DNA, 23 bp, Artificial Sequence
  source: /note="Description of Artificial Sequence: Synthetic oligonucleotide"
gaccttcgtctgcgaggcgaggg

SEQ ID NO: 1061 - DNA, 23 bp, Artificial Sequence
  source: /note="Description of Artificial Sequence: Synthetic oligonucleotide"
ccttcgtctgcgaggcgagggag

SEQ ID NO: 1062 - DNA, 23 bp, Artificial Sequence
  source: /note="Description of Artificial Sequence: Synthetic oligonucleotide"
aggcgagggagttcttcttctag

SEQ ID NO: 1063 - DNA, 23 bp, Artificial Sequence
  source: /note="Description of Artificial Sequence: Synthetic oligonucleotide"
ggcgagggagttcttcttctagg

SEQ ID NO: 1064 - DNA, 23 bp, Artificial Sequence
  source: /note="Description of Artificial Sequence: Synthetic oligonucleotide"
gcgagggagttcttcttctaggg

SEQ ID NO: 1065 - DNA, 23 bp, Artificial Sequence
  source: /note="Description of Artificial Sequence: Synthetic oligonucleotide"
cgagggagttcttcttctagggg

SEQ ID NO: 1066 - DNA, 23 bp, Artificial Sequence
  source: /note="Description of Artificial Sequence: Synthetic oligonucleotide"
cctgcctcgtcgtctaacaacag

SEQ ID NO: 1067 - DNA, 23 bp, Artificial Sequence
  source: /note="Description of Artificial Sequence: Synthetic oligonucleotide"
gcctcgtcgtctaacaacagtag

SEQ ID NO: 1068 - DNA, 23 bp, Artificial Sequence
  source: /note="Description of Artificial Sequence: Synthetic oligonucleotide"
cgtctaacaacagtagtttccgg

SEQ ID NO: 1069 - DNA, 23 bp, Artificial Sequence
  source: /note="Description of Artificial Sequence: Synthetic oligonucleotide"
ctaacaacagtagtttccggaag

SEQ ID NO: 1070 - DNA, 23 bp, Artificial Sequence
  source: /note="Description of Artificial Sequence: Synthetic oligonucleotide"
gtagtttccggaagtgttgatag

SEQ ID NO: 1071 - DNA, 23 bp, Artificial Sequence
  source: /note="Description of Artificial Sequence: Synthetic oligonucleotide"
tagtttccggaagtgttgatagg

SEQ ID NO: 1072 - DNA, 23 bp, Artificial Sequence
  source: /note="Description of Artificial Sequence: Synthetic oligonucleotide"
ttccggaagtgttgataggatag

SEQ ID NO: 1073 - DNA, 23 bp, Artificial Sequence
  source: /note="Description of Artificial Sequence: Synthetic oligonucleotide"
tccggaagtgttgataggatagg

SEQ ID NO: 1074 - DNA, 23 bp, Artificial Sequence
  source: /note="Description of Artificial Sequence: Synthetic oligonucleotide"
ccggaagtgttgataggataggg

SEQ ID NO: 1075 - DNA, 23 bp, Artificial Sequence
  source: /note="Description of Artificial Sequence: Synthetic oligonucleotide"
cggaagtgttgataggatagggg

SEQ ID NO: 1076 - DNA, 23 bp, Artificial Sequence
  source: /note="Description of Artificial Sequence: Synthetic oligonucleotide"
gttgataggataggggcatttgg

SEQ ID NO: 1077 - DNA, 23 bp, Artificial Sequence
  source: /note="Description of Artificial Sequence: Synthetic oligonucleotide"
gataggataggggcatttggtgg

SEQ ID NO: 1078 - DNA, 23 bp, Artificial Sequence
  source: /note="Description of Artificial Sequence: Synthetic oligonucleotide"
aggggcatttggtggtctataag

SEQ ID NO: 1079 - DNA, 23 bp, Artificial Sequence
  source: /note="Description of Artificial Sequence: Synthetic oligonucleotide"
gcatttggtggtctataagctgg

SEQ ID NO: 1080 - DNA, 23 bp, Artificial Sequence
  source: /note="Description of Artificial Sequence: Synthetic oligonucleotide"
atttggtggtctataagctggag

SEQ ID NO: 1081 - DNA, 23 bp, Artificial Sequence
  source: /note="Description of Artificial Sequence: Synthetic oligonucleotide"
tttggtggtctataagctggagg

SEQ ID NO: 1082 - DNA, 23 bp, Artificial Sequence
  source: /note="Description of Artificial Sequence: Synthetic oligonucleotide"
tggtggtctataagctggaggag

SEQ ID NO: 1083 - DNA, 23 bp, Artificial Sequence
  source: /note="Description of Artificial Sequence: Synthetic oligonucleotide"
agtgcgaatccacactccgaaag

SEQ ID NO: 1084 - DNA, 23 bp, Artificial Sequence
  source: /note="Description of Artificial Sequence: Synthetic oligonucleotide"
agacaccaaatactctataacgg

SEQ ID NO: 1085 - DNA, 23 bp, Artificial Sequence
  source: /note="Description of Artificial Sequence: Synthetic oligonucleotide"
tataacggtttctcttccaaaag

SEQ ID NO: 1086 - DNA, 23 bp, Artificial Sequence
  source: /note="Description of Artificial Sequence: Synthetic oligonucleotide"
acggtttctcttccaaaagtgag

SEQ ID NO: 1087 - DNA, 23 bp, Artificial Sequence
  source: /note="Description of Artificial Sequence: Synthetic oligonucleotide"
ttctcttccaaaagtgagacaag

SEQ ID NO: 1088 - DNA, 23 bp, Artificial Sequence
  source: /note="Description of Artificial Sequence: Synthetic oligonucleotide"
gacaagaaatgtgaaaccacaag

SEQ ID NO: 1089 - DNA, 23 bp, Artificial Sequence
  source: /note="Description of Artificial Sequence: Synthetic oligonucleotide"
caagaaatgtgaaaccacaagag

SEQ ID NO: 1090 - DNA, 23 bp, Artificial Sequence
  source: /note="Description of Artificial Sequence: Synthetic oligonucleotide"
cacaagagttgcctgaactttag

SEQ ID NO: 1091 - DNA, 23 bp, Artificial Sequence
  source: /note="Description of Artificial Sequence: Synthetic oligonucleotide"
acaagagttgcctgaactttagg

SEQ ID NO: 1092 - DNA, 23 bp, Artificial Sequence
  source: /note="Description of Artificial Sequence: Synthetic oligonucleotide"
cctgaactttaggcccatattag

SEQ ID NO: 1093 - DNA, 23 bp, Artificial Sequence
  source: /note="Description of Artificial Sequence: Synthetic oligonucleotide"
gtgttgacataactgactactag

SEQ ID NO: 1094 - DNA, 23 bp, Artificial Sequence
  source: /note="Description of Artificial Sequence: Synthetic oligonucleotide"
tgttgacataactgactactagg

SEQ ID NO: 1095 - DNA, 23 bp, Artificial Sequence
  source: /note="Description of Artificial Sequence: Synthetic oligonucleotide"
ataactgactactaggtctctag

SEQ ID NO: 1096 - DNA, 23 bp, Artificial Sequence
  source: /note="Description of Artificial Sequence: Synthetic oligonucleotide"
actactaggtctctagatgctgg

SEQ ID NO: 1097 - DNA, 23 bp, Artificial Sequence
  source: /note="Description of Artificial Sequence: Synthetic oligonucleotide"
cttccaaattaacacccacccag

SEQ ID NO: 1098 - DNA, 23 bp, Artificial Sequence
  source: /note="Description of Artificial Sequence: Synthetic oligonucleotide"
ttccaaattaacacccacccagg

SEQ ID NO: 1099 - DNA, 23 bp, Artificial Sequence
  source: /note="Description of Artificial Sequence: Synthetic oligonucleotide"
caaattaacacccacccaggtag

SEQ ID NO: 1100 - DNA, 23 bp, Artificial Sequence
  source: /note="Description of Artificial Sequence: Synthetic oligonucleotide"
ttaacacccacccaggtagctag

SEQ ID NO: 1101 - DNA, 23 bp, Artificial Sequence
  source: /note="Description of Artificial Sequence: Synthetic oligonucleotide"
aacacccacccaggtagctagag

SEQ ID NO: 1102 - DNA, 23 bp, Artificial Sequence
  source: /note="Description of Artificial Sequence: Synthetic oligonucleotide"
acccaggtagctagagtcattag

SEQ ID NO: 1103 - DNA, 23 bp, Artificial Sequence
  source: /note="Description of Artificial Sequence: Synthetic oligonucleotide"
ctagagtcattagttccccccag

SEQ ID NO: 1104 - DNA, 23 bp, Artificial Sequence
  source: /note="Description of Artificial Sequence: Synthetic oligonucleotide"
gtcattagttccccccagcaaag

SEQ ID NO: 1105 - DNA, 23 bp, Artificial Sequence
  source: /note="Description of Artificial Sequence: Synthetic oligonucleotide"
cagcaaagaattgcttgcctgag

SEQ ID NO: 1106 - DNA, 23 bp, Artificial Sequence
  source: /note="Description of Artificial Sequence: Synthetic oligonucleotide"
aagaattgcttgcctgagtgcag

SEQ ID NO: 1107 - DNA, 23 bp, Artificial Sequence
  source: /note="Description of Artificial Sequence: Synthetic oligonucleotide"
ttgcttgcctgagtgcagtatgg

SEQ ID NO: 1108 - DNA, 23 bp, Artificial Sequence
  source: /note="Description of Artificial Sequence: Synthetic oligonucleotide"
ttgcctgagtgcagtatggtgag

SEQ ID NO: 1109 - DNA, 23 bp, Artificial Sequence
  source: /note="Description of Artificial Sequence: Synthetic oligonucleotide"
tgcctgagtgcagtatggtgagg

SEQ ID NO: 1110 - DNA, 23 bp, Artificial Sequence
  source: /note="Description of Artificial Sequence: Synthetic oligonucleotide"
atggtgaggtgaacaatgctcag

SEQ ID NO: 1111 - DNA, 23 bp, Artificial Sequence
  source: /note="Description of Artificial Sequence: Synthetic oligonucleotide"
tggtgaggtgaacaatgctcagg

SEQ ID NO: 1112 - DNA, 23 bp, Artificial Sequence
  source: /note="Description of Artificial Sequence: Synthetic oligonucleotide"
gtgaggtgaacaatgctcaggag

SEQ ID NO: 1113 - DNA, 23 bp, Artificial Sequence
  source: /note="Description of Artificial Sequence: Synthetic oligonucleotide"
aacaatgctcaggagactctaag

SEQ ID NO: 1114 - DNA, 23 bp, Artificial Sequence
  source: /note="Description of Artificial Sequence: Synthetic oligonucleotide"
acaatgctcaggagactctaagg

SEQ ID NO: 1115 - DNA, 23 bp, Artificial Sequence
  source: /note="Description of Artificial Sequence: Synthetic oligonucleotide"
gactctaaggcttcccgatacag

SEQ ID NO: 1116 - DNA, 23 bp, Artificial Sequence
  source: /note="Description of Artificial Sequence: Synthetic oligonucleotide"
ctctaaggcttcccgatacagag

SEQ ID NO: 1117 - DNA, 23 bp, Artificial Sequence
  source: /note="Description of Artificial Sequence: Synthetic oligonucleotide"
aggcttcccgatacagagctgag

SEQ ID NO: 1118 - DNA, 23 bp, Artificial Sequence
  source: /note="Description of Artificial Sequence: Synthetic oligonucleotide"
ggcttcccgatacagagctgagg

SEQ ID NO: 1119 - DNA, 23 bp, Artificial Sequence
  source: /note="Description of Artificial Sequence: Synthetic oligonucleotide"
ttcccgatacagagctgaggcgg

SEQ ID NO: 1120 - DNA, 23 bp, Artificial Sequence
  source: /note="Description of Artificial Sequence: Synthetic oligonucleotide"
tacagagctgaggcggtatctag

SEQ ID NO: 1121 - DNA, 23 bp, Artificial Sequence
  source: /note="Description of Artificial Sequence: Synthetic oligonucleotide"
agagctgaggcggtatctagaag

SEQ ID NO: 1122 - DNA, 23 bp, Artificial Sequence
  source: /note="Description of Artificial Sequence: Synthetic oligonucleotide"
atctagaagatctcgtactgaag

SEQ ID NO: 1123 - DNA, 23 bp, Artificial Sequence
  source: /note="Description of Artificial Sequence: Synthetic oligonucleotide"
tctagaagatctcgtactgaagg

SEQ ID NO: 1124 - DNA, 23 bp, Artificial Sequence
  source: /note="Description of Artificial Sequence: Synthetic oligonucleotide"
gaagatctcgtactgaaggaaag

SEQ ID NO: 1125 - DNA, 23 bp, Artificial Sequence
  source: /note="Description of Artificial Sequence: Synthetic oligonucleotide"
gatctcgtactgaaggaaagaag

SEQ ID NO: 1126 - DNA, 23 bp, Artificial Sequence
  source: /note="Description of Artificial Sequence: Synthetic oligonucleotide"
tcgtactgaaggaaagaagtcag

SEQ ID NO: 1127 - DNA, 23 bp, Artificial Sequence
  source: /note="Description of Artificial Sequence: Synthetic oligonucleotide"
tactgaaggaaagaagtcagaag

SEQ ID NO: 1128 - DNA, 23 bp, Artificial Sequence
  source: /note="Description of Artificial Sequence: Synthetic oligonucleotide"
actgaaggaaagaagtcagaagg

SEQ ID NO: 1129 - DNA, 23 bp, Artificial Sequence
  source: /note="Description of Artificial Sequence: Synthetic oligonucleotide"
agaagtcagaaggcaaaaacgag

SEQ ID NO: 1130 - DNA, 23 bp, Artificial Sequence
  source: /note="Description of Artificial Sequence: Synthetic oligonucleotide"
aagtcagaaggcaaaaacgagag

SEQ ID NO: 1131 - DNA, 23 bp, Artificial Sequence
  source: /note="Description of Artificial Sequence: Synthetic oligonucleotide"
caaaaacgagagtaactccacag

SEQ ID NO: 1132 - DNA, 23 bp, Artificial Sequence
  source: /note="Description of Artificial Sequence: Synthetic oligonucleotide"
aaacgagagtaactccacagtag

SEQ ID NO: 1133 - DNA, 23 bp, Artificial Sequence
  source: /note="Description of Artificial Sequence: Synthetic oligonucleotide"
agtagctccaaattctttataag

SEQ ID NO: 1134 - DNA, 23 bp, Artificial Sequence
  source: /note="Description of Artificial Sequence: Synthetic oligonucleotide"
gtagctccaaattctttataagg

SEQ ID NO: 1135 - DNA, 23 bp, Artificial Sequence
  source: /note="Description of Artificial Sequence: Synthetic oligonucleotide"
tagctccaaattctttataaggg

SEQ ID NO: 1136 - DNA, 23 bp, Artificial Sequence
  source: /note="Description of Artificial Sequence: Synthetic oligonucleotide"
gggtcgatgtccatgccccaaag

SEQ ID NO: 1137 - DNA, 23 bp, Artificial Sequence
  source: /note="Description of Artificial Sequence: Synthetic oligonucleotide"
tccatgccccaaagccacccaag

SEQ ID NO: 1138 - DNA, 23 bp, Artificial Sequence
  source: /note="Description of Artificial Sequence: Synthetic oligonucleotide"
ccatgccccaaagccacccaagg

SEQ ID NO: 1139 - DNA, 23 bp, Artificial Sequence
  source: /note="Description of Artificial Sequence: Synthetic oligonucleotide"
ccccaaagccacccaaggcacag

SEQ ID NO: 1140 - DNA, 23 bp, Artificial Sequence
  source: /note="Description of Artificial Sequence: Synthetic oligonucleotide"
aagccacccaaggcacagcttgg

SEQ ID NO: 1141 - DNA, 23 bp, Artificial Sequence
  source: /note="Description of Artificial Sequence: Synthetic oligonucleotide"
gccacccaaggcacagcttggag

SEQ ID NO: 1142 - DNA, 23 bp, Artificial Sequence
  source: /note="Description of Artificial Sequence: Synthetic oligonucleotide"
ccacccaaggcacagcttggagg

SEQ ID NO: 1143 - DNA, 23 bp, Artificial Sequence
  source: /note="Description of Artificial Sequence: Synthetic oligonucleotide"
gcacagcttggaggcttgaacag

SEQ ID NO: 1144 - DNA, 23 bp, Artificial Sequence
  source: /note="Description of Artificial Sequence: Synthetic oligonucleotide"
cagcttggaggcttgaacagtag

SEQ ID NO: 1145 - DNA, 23 bp, Artificial Sequence
  source: /note="Description of Artificial Sequence: Synthetic oligonucleotide"
agcttggaggcttgaacagtagg

SEQ ID NO: 1146 - DNA, 23 bp, Artificial Sequence
  source: /note="Description of Artificial Sequence: Synthetic oligonucleotide"
ttgaacagtaggacatgaacaag

SEQ ID NO: 1147 - DNA, 23 bp, Artificial Sequence
  source: /note="Description of Artificial Sequence: Synthetic oligonucleotide"
gaacagtaggacatgaacaagag

SEQ ID NO: 1148 - DNA, 23 bp, Artificial Sequence
  source: /note="Description of Artificial Sequence: Synthetic oligonucleotide"
ggacatgaacaagagatgattag

SEQ ID NO: 1149 - DNA, 23 bp, Artificial Sequence
  source: /note="Description of Artificial Sequence: Synthetic oligonucleotide"
gacatgaacaagagatgattagg

SEQ ID NO: 1150 - DNA, 23 bp, Artificial Sequence
  source: /note="Description of Artificial Sequence: Synthetic oligonucleotide"
atgaacaagagatgattaggcag

SEQ ID NO: 1151 - DNA, 23 bp, Artificial Sequence
  source: /note="Description of Artificial Sequence: Synthetic oligonucleotide"
gaacaagagatgattaggcagag

SEQ ID NO: 1152 - DNA, 23 bp, Artificial Sequence
  source: /note="Description of Artificial Sequence: Synthetic oligonucleotide"
aacaagagatgattaggcagagg

SEQ ID NO: 1153 - DNA, 23 bp, Artificial Sequence
  source: /note="Description of Artificial Sequence: Synthetic oligonucleotide"
atgattaggcagaggtgaaaaag

SEQ ID NO: 1154 - DNA, 23 bp, Artificial Sequence
  source: /note="Description of Artificial Sequence: Synthetic oligonucleotide"
gcagaggtgaaaaagttgcatgg

SEQ ID NO: 1155 - DNA, 23 bp, Artificial Sequence
  source: /note="Description of Artificial Sequence: Synthetic oligonucleotide"
gtgaaaaagttgcatggtgctgg

SEQ ID NO: 1156 - DNA, 23 bp, Artificial Sequence
  source: /note="Description of Artificial Sequence: Synthetic oligonucleotide"
agttgcatggtgctggtgcgcag

SEQ ID NO: 1157 - DNA, 23 bp, Artificial Sequence
  source: /note="Description of Artificial Sequence: Synthetic oligonucleotide"
cgcagaccaatttatgcctacag

SEQ ID NO: 1158 - DNA, 23 bp, Artificial Sequence
  source: /note="Description of Artificial Sequence: Synthetic oligonucleotide"
aatttatgcctacagcctcctag

SEQ ID NO: 1159 - DNA, 23 bp, Artificial Sequence
  source: /note="Description of Artificial Sequence: Synthetic oligonucleotide"
gcctacagcctcctagtacaaag

SEQ ID NO: 1160 - DNA, 23 bp, Artificial Sequence
  source: /note="Description of Artificial Sequence: Synthetic oligonucleotide"
tctcctcccccaactcctcccag

SEQ ID NO: 1161 - DNA, 23 bp, Artificial Sequence
  source: /note="Description of Artificial Sequence: Synthetic oligonucleotide"
cctcccagtctttaaacaaacag

SEQ ID NO: 1162 - DNA, 23 bp, Artificial Sequence
  source: /note="Description of Artificial Sequence: Synthetic oligonucleotide"
ctttaaacaaacagtctttgaag

SEQ ID NO: 1163 - DNA, 23 bp, Artificial Sequence
  source: /note="Description of Artificial Sequence: Synthetic oligonucleotide"
cagtctttgaagtatgcctcaag

SEQ ID NO: 1164 - DNA, 23 bp, Artificial Sequence
  source: /note="Description of Artificial Sequence: Synthetic oligonucleotide"
agtctttgaagtatgcctcaagg

SEQ ID NO: 1165 - DNA, 23 bp, Artificial Sequence
  source: /note="Description of Artificial Sequence: Synthetic oligonucleotide"
tttgaagtatgcctcaaggtcgg

SEQ ID NO: 1166 - DNA, 23 bp, Artificial Sequence
  source: /note="Description of Artificial Sequence: Synthetic oligonucleotide"
aaggtcggtcgttgacattgcag

SEQ ID NO: 1167 - DNA, 23 bp, Artificial Sequence
  source: /note="Description of Artificial Sequence: Synthetic oligonucleotide"
ggtcggtcgttgacattgcagag

SEQ ID NO: 1168 - DNA, 23 bp, Artificial Sequence
  source: /note="Description of Artificial Sequence: Synthetic oligonucleotide"
tcggtcgttgacattgcagagag

SEQ ID NO: 1169 - DNA, 23 bp, Artificial Sequence
  source: /note="Description of Artificial Sequence: Synthetic oligonucleotide"
gttgacattgcagagagtccaag

SEQ ID NO: 1170 - DNA, 23 bp, Artificial Sequence
  source: /note="Description of Artificial Sequence: Synthetic oligonucleotide"
tgacattgcagagagtccaagag

SEQ ID NO: 1171 - DNA, 23 bp, Artificial Sequence
  source: /note="Description of Artificial Sequence: Synthetic oligonucleotide"
gtccaagagtcctcttatgtaag

SEQ ID NO: 1172 - DNA, 23 bp, Artificial Sequence
  source: /note="Description of Artificial Sequence: Synthetic oligonucleotide"
agtcctcttatgtaagaccttgg

SEQ ID NO: 1173 - DNA, 23 bp, Artificial Sequence
  source: /note="Description of Artificial Sequence: Synthetic oligonucleotide"
gtcctcttatgtaagaccttggg

SEQ ID NO: 1174 - DNA, 23 bp, Artificial Sequence
  source: /note="Description of Artificial Sequence: Synthetic oligonucleotide"
gtaagaccttgggcaacattcgg

SEQ ID NO: 1175 - DNA, 23 bp, Artificial Sequence
  source: /note="Description of Artificial Sequence: Synthetic oligonucleotide"
agaccttgggcaacattcggtgg

SEQ ID NO: 1176 - DNA, 23 bp, Artificial Sequence
  source: /note="Description of Artificial Sequence: Synthetic oligonucleotide"
gaccttgggcaacattcggtggg

SEQ ID NO: 1177 - DNA, 23 bp, Artificial Sequence
  source: /note="Description of Artificial Sequence: Synthetic oligonucleotide"
caacattcggtgggcgttcacgg

SEQ ID NO: 1178 - DNA, 23 bp, Artificial Sequence
  source: /note="Description of Artificial Sequence: Synthetic oligonucleotide"
cattcggtgggcgttcacggtgg

SEQ ID NO: 1179 - DNA, 23 bp, Artificial Sequence
  source: /note="Description of Artificial Sequence: Synthetic oligonucleotide"
ggtggtctccatgcgacgtgcag

SEQ ID NO: 1180 - DNA, 23 bp, Artificial Sequence
  source: /note="Description of Artificial Sequence: Synthetic oligonucleotide"
tggtctccatgcgacgtgcagag

SEQ ID NO: 1181 - DNA, 23 bp, Artificial Sequence
  source: /note="Description of Artificial Sequence: Synthetic oligonucleotide"
ggtctccatgcgacgtgcagagg

SEQ ID NO: 1182 - DNA, 23 bp, Artificial Sequence
  source: /note="Description of Artificial Sequence: Synthetic oligonucleotide"
ccatgcgacgtgcagaggtgaag

SEQ ID NO: 1183 - DNA, 23 bp, Artificial Sequence
  source: /note="Description of Artificial Sequence: Synthetic oligonucleotide"
cgacgtgcagaggtgaagcgaag

SEQ ID NO: 1184 - DNA, 23 bp, Artificial Sequence
  source: /note="Description of Artificial Sequence: Synthetic oligonucleotide"
gaggtgaagcgaagtgcacacgg

SEQ ID NO: 1185 - DNA, 23 bp, Artificial Sequence
  source: /note="Description of Artificial Sequence: Synthetic oligonucleotide"
gaagcgaagtgcacacggtccgg

SEQ ID NO: 1186 - DNA, 23 bp, Artificial Sequence
  source: /note="Description of Artificial Sequence: Synthetic oligonucleotide"
gcgaagtgcacacggtccggcag

SEQ ID NO: 1187 - DNA, 23 bp, Artificial Sequence
  source: /note="Description of Artificial Sequence: Synthetic oligonucleotide"
gtgcacacggtccggcagatgag

SEQ ID NO: 1188 - DNA, 23 bp, Artificial Sequence
  source: /note="Description of Artificial Sequence: Synthetic oligonucleotide"
cacacggtccggcagatgagaag

SEQ ID NO: 1189 - DNA, 23 bp, Artificial Sequence
  source: /note="Description of Artificial Sequence: Synthetic oligonucleotide"
acacggtccggcagatgagaagg

SEQ ID NO: 1190 - DNA, 23 bp, Artificial Sequence
  source: /note="Description of Artificial Sequence: Synthetic oligonucleotide"
gtccggcagatgagaaggcacag

SEQ ID NO: 1191 - DNA, 23 bp, Artificial Sequence
  source: /note="Description of Artificial Sequence: Synthetic oligonucleotide"
ggcagatgagaaggcacagacgg

SEQ ID NO: 1192 - DNA, 23 bp, Artificial Sequence
  source: /note="Description of Artificial Sequence: Synthetic oligonucleotide"
gcagatgagaaggcacagacggg

SEQ ID NO: 1193 - DNA, 23 bp, Artificial Sequence
  source: /note="Description of Artificial Sequence: Synthetic oligonucleotide"
cagatgagaaggcacagacgggg

SEQ ID NO: 1194 - DNA, 23 bp, Artificial Sequence
  source: /note="Description of Artificial Sequence: Synthetic oligonucleotide"
gatgagaaggcacagacggggag

SEQ ID NO: 1195 - DNA, 23 bp, Artificial Sequence
  source: /note="Description of Artificial Sequence: Synthetic oligonucleotide"
acagacggggagtccgcgtaaag

SEQ ID NO: 1196 - DNA, 23 bp, Artificial Sequence
  source: /note="Description of Artificial Sequence: Synthetic oligonucleotide"
agacggggagtccgcgtaaagag

SEQ ID NO: 1197 - DNA, 23 bp, Artificial Sequence
  source: /note="Description of Artificial Sequence: Synthetic oligonucleotide"
acggggagtccgcgtaaagagag

SEQ ID NO: 1198 - DNA, 23 bp, Artificial Sequence
  source: /note="Description of Artificial Sequence: Synthetic oligonucleotide"
cggggagtccgcgtaaagagagg

SEQ ID NO: 1199 - DNA, 23 bp, Artificial Sequence
  source: /note="Description of Artificial Sequence: Synthetic oligonucleotide"
gtaaagagaggtgcgccccgtgg

SEQ ID NO: 1200 - DNA, 23 bp, Artificial Sequence
  source: /note="Description of Artificial Sequence: Synthetic oligonucleotide"
agagaggtgcgccccgtggtcgg

SEQ ID NO: 1201 - DNA, 23 bp, Artificial Sequence
  source: /note="Description of Artificial Sequence: Synthetic oligonucleotide"
aggtgcgccccgtggtcggtcgg

SEQ ID NO: 1202 - DNA, 23 bp, Artificial Sequence
  source: /note="Description of Artificial Sequence: Synthetic oligonucleotide"
cgccccgtggtcggtcggaacgg

SEQ ID NO: 1203 - DNA, 23 bp, Artificial Sequence
  source: /note="Description of Artificial Sequence: Synthetic oligonucleotide"
cccgtggtcggtcggaacggcag

SEQ ID NO: 1204 - DNA, 23 bp, Artificial Sequence
  source: /note="Description of Artificial Sequence: Synthetic oligonucleotide"
tggtcggtcggaacggcagacgg

SEQ ID NO: 1205 - DNA, 23 bp, Artificial Sequence
  source: /note="Description of Artificial Sequence: Synthetic oligonucleotide"
gtcggtcggaacggcagacggag

SEQ ID NO: 1206 - DNA, 23 bp, Artificial Sequence
  source: /note="Description of Artificial Sequence: Synthetic oligonucleotide"
ggtcggaacggcagacggagaag

SEQ ID NO: 1207 - DNA, 23 bp, Artificial Sequence
  source: /note="Description of Artificial Sequence: Synthetic oligonucleotide"
gtcggaacggcagacggagaagg

SEQ ID NO: 1208 - DNA, 23 bp, Artificial Sequence
  source: /note="Description of Artificial Sequence: Synthetic oligonucleotide"
tcggaacggcagacggagaaggg

SEQ ID NO: 1209 - DNA, 23 bp, Artificial Sequence
  source: /note="Description of Artificial Sequence: Synthetic oligonucleotide"
cggaacggcagacggagaagggg

SEQ ID NO: 1210 - DNA, 23 bp, Artificial Sequence
  source: /note="Description of Artificial Sequence: Synthetic oligonucleotide"
cggcagacggagaaggggacgag

SEQ ID NO: 1211 - DNA, 23 bp, Artificial Sequence
  source: /note="Description of Artificial Sequence: Synthetic oligonucleotide"
gcagacggagaaggggacgagag

SEQ ID NO: 1212 - DNA, 23 bp, Artificial Sequence
  source: /note="Description of Artificial Sequence: Synthetic oligonucleotide"
agacggagaaggggacgagagag

SEQ ID NO: 1213 - DNA, 23 bp, Artificial Sequence
  source: /note="Description of Artificial Sequence: Synthetic oligonucleotide"
gaaggggacgagagagtcccaag

SEQ ID NO: 1214 - DNA, 23 bp, Artificial Sequence
  source: /note="Description of Artificial Sequence: Synthetic oligonucleotide"
agagagtcccaagcgaccccgag

SEQ ID NO: 1215 - DNA, 23 bp, Artificial Sequence
  source: /note="Description of Artificial Sequence: Synthetic oligonucleotide"
gagtcccaagcgaccccgagaag

SEQ ID NO: 1216 - DNA, 23 bp, Artificial Sequence
  source: /note="Description of Artificial Sequence: Synthetic oligonucleotide"
agtcccaagcgaccccgagaagg

SEQ ID NO: 1217 - DNA, 23 bp, Artificial Sequence
  source: /note="Description of Artificial Sequence: Synthetic oligonucleotide"
gtcccaagcgaccccgagaaggg

SEQ ID NO: 1218 - DNA, 23 bp, Artificial Sequence
  source: /note="Description of Artificial Sequence: Synthetic oligonucleotide"
accccgagaagggtcgtccgcag

SEQ ID NO: 1219 - DNA, 23 bp, Artificial Sequence
  source: /note="Description of Artificial Sequence: Synthetic oligonucleotide"
ccccgagaagggtcgtccgcagg

SEQ ID NO: 1220 - DNA, 23 bp, Artificial Sequence
  source: /note="Description of Artificial Sequence: Synthetic oligonucleotide"
gaagggtcgtccgcaggattcag

SEQ ID NO: 1221 - DNA, 23 bp, Artificial Sequence
  source: /note="Description of Artificial Sequence: Synthetic oligonucleotide"
tccgcaggattcagcgccgacgg

SEQ ID NO: 1222 - DNA, 23 bp, Artificial Sequence
  source: /note="Description of Artificial Sequence: Synthetic oligonucleotide"
ccgcaggattcagcgccgacggg

SEQ ID NO: 1223 - DNA, 23 bp, Artificial Sequence
  source: /note="Description of Artificial Sequence: Synthetic oligonucleotide"
gcgccgacgggacgtaaacaaag

SEQ ID NO: 1224 - DNA, 23 bp, Artificial Sequence
  source: /note="Description of Artificial Sequence: Synthetic oligonucleotide"
cgccgacgggacgtaaacaaagg

SEQ ID NO: 1225 - DNA, 23 bp, Artificial Sequence
  source: /note="Description of Artificial Sequence: Synthetic oligonucleotide"
taaacaaaggacgtcccgcgcag

SEQ ID NO: 1226 - DNA, 23 bp, Artificial Sequence
  source: /note="Description of Artificial Sequence: Synthetic oligonucleotide"
aaacaaaggacgtcccgcgcagg

SEQ ID NO: 1227 - DNA, 23 bp, Artificial Sequence
  source: /note="Description of Artificial Sequence: Synthetic oligonucleotide"
aggacgtcccgcgcaggatccag

SEQ ID NO: 1228 - DNA, 23 bp, Artificial Sequence
  source: /note="Description of Artificial Sequence: Synthetic oligonucleotide"
cgtcccgcgcaggatccagttgg

SEQ ID NO: 1229 - DNA, 23 bp, Artificial Sequence
  source: /note="Description of Artificial Sequence: Synthetic oligonucleotide"
cccgcgcaggatccagttggcag

SEQ ID NO: 1230 - DNA, 23 bp, Artificial Sequence
  source: /note="Description of Artificial Sequence: Synthetic oligonucleotide"
gcaggatccagttggcagcacag

SEQ ID NO: 1231 - DNA, 23 bp, Artificial Sequence
  source: /note="Description of Artificial Sequence: Synthetic oligonucleotide"
atccagttggcagcacagcctag

SEQ ID NO: 1232 - DNA, 23 bp, Artificial Sequence
  source: /note="Description of Artificial Sequence: Synthetic oligonucleotide"
cagttggcagcacagcctagcag

SEQ ID NO: 1233 - DNA, 23 bp, Artificial Sequence
  source: /note="Description of Artificial Sequence: Synthetic oligonucleotide"
gcagcacagcctagcagccatgg

SEQ ID NO: 1234 - DNA, 23 bp, Artificial Sequence
  source: /note="Description of Artificial Sequence: Synthetic oligonucleotide"
atggatacgatgtatatttgcgg

SEQ ID NO: 1235 - DNA, 23 bp, Artificial Sequence
  source: /note="Description of Artificial Sequence: Synthetic oligonucleotide"
tggatacgatgtatatttgcggg

SEQ ID NO: 1236 - DNA, 23 bp, Artificial Sequence
  source: /note="Description of Artificial Sequence: Synthetic oligonucleotide"
gatacgatgtatatttgcgggag

SEQ ID NO: 1237 - DNA, 23 bp, Artificial Sequence
  source: /note="Description of Artificial Sequence: Synthetic oligonucleotide"
tacgatgtatatttgcgggagag

SEQ ID NO: 1238 - DNA, 23 bp, Artificial Sequence
  source: /note="Description of Artificial Sequence: Synthetic oligonucleotide"
acgatgtatatttgcgggagagg

SEQ ID NO: 1239 - DNA, 23 bp, Artificial Sequence
  source: /note="Description of Artificial Sequence: Synthetic oligonucleotide"
atatttgcgggagaggacaacag

SEQ ID NO: 1240 - DNA, 23 bp, Artificial Sequence
  source: /note="Description of Artificial Sequence: Synthetic oligonucleotide"
atttgcgggagaggacaacagag

SEQ ID NO: 1241 - DNA, 23 bp, Artificial Sequence
  source: /note="Description of Artificial Sequence: Synthetic oligonucleotide"
ggagaggacaacagagttatcag

SEQ ID NO: 1242 - DNA, 23 bp, Artificial Sequence
  source: /note="Description of Artificial Sequence: Synthetic oligonucleotide"
agtcccgataatgtttgctccag

SEQ ID NO: 1243 - DNA, 23 bp, Artificial Sequence
  source: /note="Description of Artificial Sequence: Synthetic oligonucleotide"
gtttgctccagacctgctgcgag

SEQ ID NO: 1244 - DNA, 23 bp, Artificial Sequence
  source: /note="Description of Artificial Sequence: Synthetic oligonucleotide"
agacctgctgcgagcaaaacaag

SEQ ID NO: 1245 - DNA, 23 bp, Artificial Sequence
  source: /note="Description of Artificial Sequence: Synthetic oligonucleotide"
cctgctgcgagcaaaacaagcgg

SEQ ID NO: 1246 - DNA, 23 bp, Artificial Sequence
  source: /note="Description of Artificial Sequence: Synthetic oligonucleotide"
ctgcgagcaaaacaagcggctag

SEQ ID NO: 1247 - DNA, 23 bp, Artificial Sequence
  source: /note="Description of Artificial Sequence: Synthetic oligonucleotide"
tgcgagcaaaacaagcggctagg

SEQ ID NO: 1248 - DNA, 23 bp, Artificial Sequence
  source: /note="Description of Artificial Sequence: Synthetic oligonucleotide"
cgagcaaaacaagcggctaggag

SEQ ID NO: 1249 - DNA, 23 bp, Artificial Sequence
  source: /note="Description of Artificial Sequence: Synthetic oligonucleotide"
acaagcggctaggagttccgcag

SEQ ID NO: 1250 - DNA, 23 bp, Artificial Sequence
  source: /note="Description of Artificial Sequence: Synthetic oligonucleotide"
cggctaggagttccgcagtatgg

SEQ ID NO: 1251 - DNA, 23 bp, Artificial Sequence
  source: /note="Description of Artificial Sequence: Synthetic oligonucleotide"
aggagttccgcagtatggatcgg

SEQ ID NO: 1252 - DNA, 23 bp, Artificial Sequence
  source: /note="Description of Artificial Sequence: Synthetic oligonucleotide"
agttccgcagtatggatcggcag

SEQ ID NO: 1253 - DNA, 23 bp, Artificial Sequence
  source: /note="Description of Artificial Sequence: Synthetic oligonucleotide"
ttccgcagtatggatcggcagag

SEQ ID NO: 1254 - DNA, 23 bp, Artificial Sequence
  source: /note="Description of Artificial Sequence: Synthetic oligonucleotide"
tccgcagtatggatcggcagagg

SEQ ID NO: 1255 - DNA, 23 bp, Artificial Sequence
  source: /note="Description of Artificial Sequence: Synthetic oligonucleotide"
cgcagtatggatcggcagaggag

SEQ ID NO: 1256 - DNA, 23 bp, Artificial Sequence
  source: /note="Description of Artificial Sequence: Synthetic oligonucleotide"
ggatcggcagaggagccgaaaag

SEQ ID NO: 1257 - DNA, 23 bp, Artificial Sequence
  source: /note="Description of Artificial Sequence: Synthetic oligonucleotide"
gatcggcagaggagccgaaaagg

SEQ ID NO: 1258 - DNA, 23 bp, Artificial Sequence
  source: /note="Description of Artificial Sequence: Synthetic oligonucleotide"
aggttccacgcacgcgctgatgg

SEQ ID NO: 1259 - DNA, 23 bp, Artificial Sequence
  source: /note="Description of Artificial Sequence: Synthetic oligonucleotide"
cgcgctgatggcccatgaccaag

SEQ ID NO: 1260 - DNA, 23 bp, Artificial Sequence
  source: /note="Description of Artificial Sequence: Synthetic oligonucleotide"
gatggcccatgaccaagccccag

SEQ ID NO: 1261 - DNA, 23 bp, Artificial Sequence
  source: /note="Description of Artificial Sequence: Synthetic oligonucleotide"
gcccatgaccaagccccagccag

SEQ ID NO: 1262 - DNA, 23 bp, Artificial Sequence
  source: /note="Description of Artificial Sequence: Synthetic oligonucleotide"
catgaccaagccccagccagtgg

SEQ ID NO: 1263 - DNA, 23 bp, Artificial Sequence
  source: /note="Description of Artificial Sequence: Synthetic oligonucleotide"
atgaccaagccccagccagtggg

SEQ ID NO: 1264 - DNA, 23 bp, Artificial Sequence
  source: /note="Description of Artificial Sequence: Synthetic oligonucleotide"
tgaccaagccccagccagtgggg

SEQ ID NO: 1265 - DNA, 23 bp, Artificial Sequence
  source: /note="Description of Artificial Sequence: Synthetic oligonucleotide"
gaccaagccccagccagtggggg

SEQ ID NO: 1266 - DNA, 23 bp, Artificial Sequence
  source: /note="Description of Artificial Sequence: Synthetic oligonucleotide"
ccagccagtgggggttgcgtcag

SEQ ID NO: 1267 - DNA, 23 bp, Artificial Sequence
  source: /note="Description of Artificial Sequence: Synthetic oligonucleotide"
gggttgcgtcagcaaacacttgg

SEQ ID NO: 1268 - DNA, 23 bp, Artificial Sequence
  source: /note="Description of Artificial Sequence: Synthetic oligonucleotide"
gcgtcagcaaacacttggcacag

SEQ ID NO: 1269 - DNA, 23 bp, Artificial Sequence
  source: /note="Description of Artificial Sequence: Synthetic oligonucleotide"
gcaaacacttggcacagacctgg

SEQ ID NO: 1270 - DNA, 23 bp, Artificial Sequence
  source: /note="Description of Artificial Sequence: Synthetic oligonucleotide"
ggcacagacctggccgttgccgg

SEQ ID NO: 1271 - DNA, 23 bp, Artificial Sequence
  source: /note="Description of Artificial Sequence: Synthetic oligonucleotide"
gcacagacctggccgttgccggg

SEQ ID NO: 1272 - DNA, 23 bp, Artificial Sequence
  source: /note="Description of Artificial Sequence: Synthetic oligonucleotide"
acctggccgttgccgggcaacgg

SEQ ID NO: 1273 - DNA, 23 bp, Artificial Sequence
  source: /note="Description of Artificial Sequence: Synthetic oligonucleotide"
cctggccgttgccgggcaacggg

SEQ ID NO: 1274 - DNA, 23 bp, Artificial Sequence
  source: /note="Description of Artificial Sequence: Synthetic oligonucleotide"
ctggccgttgccgggcaacgggg

SEQ ID NO: 1275 - DNA, 23 bp, Artificial Sequence
  source: /note="Description of Artificial Sequence: Synthetic oligonucleotide"
cgttgccgggcaacggggtaaag

SEQ ID NO: 1276 - DNA, 23 bp, Artificial Sequence
  source: /note="Description of Artificial Sequence: Synthetic oligonucleotide"
gttgccgggcaacggggtaaagg

SEQ ID NO: 1277 - DNA, 23 bp, Artificial Sequence
  source: /note="Description of Artificial Sequence: Synthetic oligonucleotide"
cgggcaacggggtaaaggttcag

SEQ ID NO: 1278 - DNA, 23 bp, Artificial Sequence
  source: /note="Description of Artificial Sequence: Synthetic oligonucleotide"
gggcaacggggtaaaggttcagg

SEQ ID NO: 1279 - DNA, 23 bp, Artificial Sequence
  source: /note="Description of Artificial Sequence: Synthetic oligonucleotide"
aggttcaggtattgtttacacag

SEQ ID NO: 1280 - DNA, 23 bp, Artificial Sequence
  source: /note="Description of Artificial Sequence: Synthetic oligonucleotide"
tcaggtattgtttacacagaaag

SEQ ID NO: 1281 - DNA, 23 bp, Artificial Sequence
  source: /note="Description of Artificial Sequence: Synthetic oligonucleotide"
caggtattgtttacacagaaagg

SEQ ID NO: 1282 - DNA, 23 bp, Artificial Sequence
  source: /note="Description of Artificial Sequence: Synthetic oligonucleotide"
tttacacagaaaggccttgtaag

SEQ ID NO: 1283 - DNA, 23 bp, Artificial Sequence
  source: /note="Description of Artificial Sequence: Synthetic oligonucleotide"
cacagaaaggccttgtaagttgg

SEQ ID NO: 1284 - DNA, 23 bp, Artificial Sequence
  source: /note="Description of Artificial Sequence: Synthetic oligonucleotide"
gaaaggccttgtaagttggcgag

SEQ ID NO: 1285 - DNA, 23 bp, Artificial Sequence
  source: /note="Description of Artificial Sequence: Synthetic oligonucleotide"
ggccttgtaagttggcgagaaag

SEQ ID NO: 1286 - DNA, 23 bp, Artificial Sequence
  source: /note="Description of Artificial Sequence: Synthetic oligonucleotide"
gtaagttggcgagaaagtgaaag

SEQ ID NO: 1287 - DNA, 23 bp, Artificial Sequence
  source: /note="Description of Artificial Sequence: Synthetic oligonucleotide"
cgagaaagtgaaagcctgcttag

SEQ ID NO: 1288 - DNA, 23 bp, Artificial Sequence
  source: /note="Description of Artificial Sequence: Synthetic oligonucleotide"
tagattgaatacatgcatacaag

SEQ ID NO: 1289 - DNA, 23 bp, Artificial Sequence
  source: /note="Description of Artificial Sequence: Synthetic oligonucleotide"
agattgaatacatgcatacaagg

SEQ ID NO: 1290 - DNA, 23 bp, Artificial Sequence
  source: /note="Description of Artificial Sequence: Synthetic oligonucleotide"
gattgaatacatgcatacaaggg

SEQ ID NO: 1291 - DNA, 23 bp, Artificial Sequence
  source: /note="Description of Artificial Sequence: Synthetic oligonucleotide"
tgcatacaagggcattaacgcag

SEQ ID NO: 1292 - DNA, 23 bp, Artificial Sequence
  source: /note="Description of Artificial Sequence: Synthetic oligonucleotide"
gcatacaagggcattaacgcagg

SEQ ID NO: 1293 - DNA, 23 bp, Artificial Sequence
  source: /note="Description of Artificial Sequence: Synthetic oligonucleotide"
ggataaccacattgtgtaaatgg

SEQ ID NO: 1294 - DNA, 23 bp, Artificial Sequence
  source: /note="Description of Artificial Sequence: Synthetic oligonucleotide"
gataaccacattgtgtaaatggg

SEQ ID NO: 1295 - DNA, 23 bp, Artificial Sequence
  source: /note="Description of Artificial Sequence: Synthetic oligonucleotide"
ataaccacattgtgtaaatgggg

SEQ ID NO: 1296 - DNA, 23 bp, Artificial Sequence
  source: /note="Description of Artificial Sequence: Synthetic oligonucleotide"
accacattgtgtaaatggggcag

SEQ ID NO: 1297 - DNA, 23 bp, Artificial Sequence
  source: /note="Description of Artificial Sequence: Synthetic oligonucleotide"
aatggggcagcaaaacccaaaag

SEQ ID NO: 1298 - DNA, 23 bp, Artificial Sequence
  source: /note="Description of Artificial Sequence: Synthetic oligonucleotide"
ttgacatactttccaatcaatag

SEQ ID NO: 1299 - DNA, 23 bp, Artificial Sequence
  source: /note="Description of Artificial Sequence: Synthetic oligonucleotide"
tgacatactttccaatcaatagg

SEQ ID NO: 1300 - DNA, 23 bp, Artificial Sequence
  source: /note="Description of Artificial Sequence: Synthetic oligonucleotide"
ccaatcaataggcctgttaatag

SEQ ID NO: 1301 - DNA, 23 bp, Artificial Sequence
  source: /note="Description of Artificial Sequence: Synthetic oligonucleotide"
caatcaataggcctgttaatagg

SEQ ID NO: 1302 - DNA, 23 bp, Artificial Sequence
  source: /note="Description of Artificial Sequence: Synthetic oligonucleotide"
tcaataggcctgttaataggaag

SEQ ID NO: 1303 - DNA, 23 bp, Artificial Sequence
  source: /note="Description of Artificial Sequence: Synthetic oligonucleotide"
ttttgtatgatgtgttcttgtgg

SEQ ID NO: 1304 - DNA, 23 bp, Artificial Sequence
  source: /note="Description of Artificial Sequence: Synthetic oligonucleotide"
gtatgatgtgttcttgtggcaag

SEQ ID NO: 1305 - DNA, 23 bp, Artificial Sequence
  source: /note="Description of Artificial Sequence: Synthetic oligonucleotide"
tatgatgtgttcttgtggcaagg

SEQ ID NO: 1306 - DNA, 23 bp, Artificial Sequence
  source: /note="Description of Artificial Sequence: Synthetic oligonucleotide"
atgacataacccataaaattcag

SEQ ID NO: 1307 - DNA, 23 bp, Artificial Sequence
  source: /note="Description of Artificial Sequence: Synthetic oligonucleotide"
gacataacccataaaattcagag

SEQ ID NO: 1308 - DNA, 23 bp, Artificial Sequence
  source: /note="Description of Artificial Sequence: Synthetic oligonucleotide"
cataacccataaaattcagagag

SEQ ID NO: 1309 - DNA, 23 bp, Artificial Sequence
  source: /note="Description of Artificial Sequence: Synthetic oligonucleotide"
accccatctctttgttttgttag

SEQ ID NO: 1310 - DNA, 23 bp, Artificial Sequence
  source: /note="Description of Artificial Sequence: Synthetic oligonucleotide"
ccccatctctttgttttgttagg

SEQ ID NO: 1311 - DNA, 23 bp, Artificial Sequence
  source: /note="Description of Artificial Sequence: Synthetic oligonucleotide"
cccatctctttgttttgttaggg

SEQ ID NO: 1312 - DNA, 23 bp, Artificial Sequence
  source: /note="Description of Artificial Sequence: Synthetic oligonucleotide"
agggtttaaatgtatacccaaag

SEQ ID NO: 1313 - DNA, 23 bp, Artificial Sequence
  source: /note="Description of Artificial Sequence: Synthetic oligonucleotide"
aaatgtatacccaaagacaaaag

SEQ ID NO: 1314 - DNA, 23 bp, Artificial Sequence
  source: /note="Description of Artificial Sequence: Synthetic oligonucleotide"
acccaaagacaaaagaaaattgg

SEQ ID NO: 1315 - DNA, 23 bp, Artificial Sequence
  source: /note="Description of Artificial Sequence: Synthetic oligonucleotide"
agacaaaagaaaattggtaacag

SEQ ID NO: 1316 - DNA, 23 bp, Artificial Sequence
  source: /note="Description of Artificial Sequence: Synthetic oligonucleotide"
caaaagaaaattggtaacagcgg

SEQ ID NO: 1317 - DNA, 23 bp, Artificial Sequence
  source: /note="Description of Artificial Sequence: Synthetic oligonucleotide"
aaattggtaacagcggtaaaaag

SEQ ID NO: 1318 - DNA, 23 bp, Artificial Sequence
  source: /note="Description of Artificial Sequence: Synthetic oligonucleotide"
aattggtaacagcggtaaaaagg

SEQ ID NO: 1319 - DNA, 23 bp, Artificial Sequence
  source: /note="Description of Artificial Sequence: Synthetic oligonucleotide"
attggtaacagcggtaaaaaggg

SEQ ID NO: 1320 - DNA, 23 bp, Artificial Sequence
  source: /note="Description of Artificial Sequence: Synthetic oligonucleotide"
acagcggtaaaaagggactcaag

SEQ ID NO: 1321 - DNA, 23 bp, Artificial Sequence
  source: /note="Description of Artificial Sequence: Synthetic oligonucleotide"
aagggactcaagatgctgtacag

SEQ ID NO: 1322 - DNA, 23 bp, Artificial Sequence
  source: /note="Description of Artificial Sequence: Synthetic oligonucleotide"
ctcaagatgctgtacagacttgg

SEQ ID NO: 1323 - DNA, 23 bp, Artificial Sequence
  source: /note="Description of Artificial Sequence: Synthetic oligonucleotide"
cacatcatccatataactgaaag

SEQ ID NO: 1324 - DNA, 23 bp, Artificial Sequence
  source: /note="Description of Artificial Sequence: Synthetic oligonucleotide"
ccatataactgaaagccaaacag

SEQ ID NO: 1325 - DNA, 23 bp, Artificial Sequence
  source: /note="Description of Artificial Sequence: Synthetic oligonucleotide"
tataactgaaagccaaacagtgg

SEQ ID NO: 1326 - DNA, 23 bp, Artificial Sequence
  source: /note="Description of Artificial Sequence: Synthetic oligonucleotide"
ataactgaaagccaaacagtggg

SEQ ID NO: 1327 - DNA, 23 bp, Artificial Sequence
  source: /note="Description of Artificial Sequence: Synthetic oligonucleotide"
taactgaaagccaaacagtgggg

SEQ ID NO: 1328 - DNA, 23 bp, Artificial Sequence
  source: /note="Description of Artificial Sequence: Synthetic oligonucleotide"
aactgaaagccaaacagtggggg

SEQ ID NO: 1329 - DNA, 23 bp, Artificial Sequence
  source: /note="Description of Artificial Sequence: Synthetic oligonucleotide"
gaaagccaaacagtgggggaaag

SEQ ID NO: 1330 - DNA, 23 bp, Artificial Sequence
  source: /note="Description of Artificial Sequence: Synthetic oligonucleotide"
cctacgaaccactgaacaaatgg

SEQ ID NO: 1331 - DNA, 23 bp, Artificial Sequence
  source: /note="Description of Artificial Sequence: Synthetic oligonucleotide"
aaccactgaacaaatggcactag

SEQ ID NO: 1332 - DNA, 23 bp, Artificial Sequence
  source: /note="Description of Artificial Sequence: Synthetic oligonucleotide"
acaaatggcactagtaaactgag

SEQ ID NO: 1333 - DNA, 23 bp, Artificial Sequence
  source: /note="Description of Artificial Sequence: Synthetic oligonucleotide"
atggcactagtaaactgagccag

SEQ ID NO: 1334 - DNA, 23 bp, Artificial Sequence
  source: /note="Description of Artificial Sequence: Synthetic oligonucleotide"
tggcactagtaaactgagccagg

SEQ ID NO: 1335 - DNA, 23 bp, Artificial Sequence
  source: /note="Description of Artificial Sequence: Synthetic oligonucleotide"
gcactagtaaactgagccaggag

SEQ ID NO: 1336 - DNA, 23 bp, Artificial Sequence
  source: /note="Description of Artificial Sequence: Synthetic oligonucleotide"
gtaaactgagccaggagaaacgg

SEQ ID NO: 1337 - DNA, 23 bp, Artificial Sequence
  source: /note="Description of Artificial Sequence: Synthetic oligonucleotide"
taaactgagccaggagaaacggg

SEQ ID NO: 1338 - DNA, 23 bp, Artificial Sequence
  source: /note="Description of Artificial Sequence: Synthetic oligonucleotide"
tgagccaggagaaacgggctgag

SEQ ID NO: 1339 - DNA, 23 bp, Artificial Sequence
  source: /note="Description of Artificial Sequence: Synthetic oligonucleotide"
gagccaggagaaacgggctgagg

SEQ ID NO: 1340 - DNA, 23 bp, Artificial Sequence
  source: /note="Description of Artificial Sequence: Synthetic oligonucleotide"
cgggctgaggcccactcccatag

SEQ ID NO: 1341 - DNA, 23 bp, Artificial Sequence
  source: /note="Description of Artificial Sequence: Synthetic oligonucleotide"
gggctgaggcccactcccatagg

SEQ ID NO: 1342 - DNA, 23 bp, Artificial Sequence
  source: /note="Description of Artificial Sequence: Synthetic oligonucleotide"
ctcccataggaattttccgaaag

SEQ ID NO: 1343 - DNA, 23 bp, Artificial Sequence
  source: /note="Description of Artificial Sequence: Synthetic oligonucleotide"
ataggaattttccgaaagcccag

SEQ ID NO: 1344 - DNA, 23 bp, Artificial Sequence
  source: /note="Description of Artificial Sequence: Synthetic oligonucleotide"
taggaattttccgaaagcccagg

SEQ ID NO: 1345 - DNA, 23 bp, Artificial Sequence
  source: /note="Description of Artificial Sequence: Synthetic oligonucleotide"
tttccgaaagcccaggatgatgg

SEQ ID NO: 1346 - DNA, 23 bp, Artificial Sequence
  source: /note="Description of Artificial Sequence: Synthetic oligonucleotide"
ttccgaaagcccaggatgatggg

SEQ ID NO: 1347 - DNA, 23 bp, Artificial Sequence
  source: /note="Description of Artificial Sequence: Synthetic oligonucleotide"
gaaagcccaggatgatgggatgg

SEQ ID NO: 1348 - DNA, 23 bp, Artificial Sequence
  source: /note="Description of Artificial Sequence: Synthetic oligonucleotide"
aaagcccaggatgatgggatggg

SEQ ID NO: 1349 - DNA, 23 bp, Artificial Sequence
  source: /note="Description of Artificial Sequence: Synthetic oligonucleotide"
aggatgatgggatgggaatacag

SEQ ID NO: 1350 - DNA, 23 bp, Artificial Sequence
  source: /note="Description of Artificial Sequence: Synthetic oligonucleotide"
ggatgatgggatgggaatacagg

SEQ ID NO: 1351 - DNA, 23 bp, Artificial Sequence
  source: /note="Description of Artificial Sequence: Synthetic oligonucleotide"
acaggtgcaatttccgtccgaag

SEQ ID NO: 1352 - DNA, 23 bp, Artificial Sequence
  source: /note="Description of Artificial Sequence: Synthetic oligonucleotide"
caggtgcaatttccgtccgaagg

SEQ ID NO: 1353 - DNA, 23 bp, Artificial Sequence
  source: /note="Description of Artificial Sequence: Synthetic oligonucleotide"
gcaatttccgtccgaaggtttgg

SEQ ID NO: 1354 - DNA, 23 bp, Artificial Sequence
  source: /note="Description of Artificial Sequence: Synthetic oligonucleotide"
ttccgtccgaaggtttggtacag

SEQ ID NO: 1355 - DNA, 23 bp, Artificial Sequence
  source: /note="Description of Artificial Sequence: Synthetic oligonucleotide"
ccgaaggtttggtacagcaacag

SEQ ID NO: 1356 - DNA, 23 bp, Artificial Sequence
  source: /note="Description of Artificial Sequence: Synthetic oligonucleotide"
cgaaggtttggtacagcaacagg

SEQ ID NO: 1357 - DNA, 23 bp, Artificial Sequence
  source: /note="Description of Artificial Sequence: Synthetic oligonucleotide"
aaggtttggtacagcaacaggag

SEQ ID NO: 1358 - DNA, 23 bp, Artificial Sequence
  source: /note="Description of Artificial Sequence: Synthetic oligonucleotide"
aggtttggtacagcaacaggagg

SEQ ID NO: 1359 - DNA, 23 bp, Artificial Sequence
  source: /note="Description of Artificial Sequence: Synthetic oligonucleotide"
ggtttggtacagcaacaggaggg

SEQ ID NO: 1360 - DNA, 23 bp, Artificial Sequence
  source: /note="Description of Artificial Sequence: Synthetic oligonucleotide"
acagcaacaggagggatacatag

SEQ ID NO: 1361 - DNA, 23 bp, Artificial Sequence
  source: /note="Description of Artificial Sequence: Synthetic oligonucleotide"
agcaacaggagggatacatagag

SEQ ID NO: 1362 - DNA, 23 bp, Artificial Sequence
  source: /note="Description of Artificial Sequence: Synthetic oligonucleotide"
gcaacaggagggatacatagagg

SEQ ID NO: 1363 - DNA, 23 bp, Artificial Sequence
  source: /note="Description of Artificial Sequence: Synthetic oligonucleotide"
gggatacatagaggttccttgag

SEQ ID NO: 1364 - DNA, 23 bp, Artificial Sequence
  source: /note="Description of Artificial Sequence: Synthetic oligonucleotide"
atacatagaggttccttgagcag

SEQ ID NO: 1365 - DNA, 23 bp, Artificial Sequence
  source: /note="Description of Artificial Sequence: Synthetic oligonucleotide"
catagaggttccttgagcagtag

SEQ ID NO: 1366 - DNA, 23 bp, Artificial Sequence
  source: /note="Description of Artificial Sequence: Synthetic oligonucleotide"
ttccttgagcagtagtcatgcag

SEQ ID NO: 1367 - DNA, 23 bp, Artificial Sequence
  source: /note="Description of Artificial Sequence: Synthetic oligonucleotide"
tccttgagcagtagtcatgcagg

SEQ ID NO: 1368 - DNA, 23 bp, Artificial Sequence
  source: /note="Description of Artificial Sequence: Synthetic oligonucleotide"
gagcagtagtcatgcaggttcgg

SEQ ID NO: 1369 - DNA, 23 bp, Artificial Sequence
  source: /note="Description of Artificial Sequence: Synthetic oligonucleotide"
gtagtcatgcaggttcggcatgg

SEQ ID NO: 1370 - DNA, 23 bp, Artificial Sequence
  source: /note="Description of Artificial Sequence: Synthetic oligonucleotide"
ggttcggcatggtcccgtgctgg

SEQ ID NO: 1371 - DNA, 23 bp, Artificial Sequence
  source: /note="Description of Artificial Sequence: Synthetic oligonucleotide"
tcggcatggtcccgtgctggtgg

SEQ ID NO: 1372 - DNA, 23 bp, Artificial Sequence
  source: /note="Description of Artificial Sequence: Synthetic oligonucleotide"
atggtcccgtgctggtggttgag

SEQ ID NO: 1373 - DNA, 23 bp, Artificial Sequence
  source: /note="Description of Artificial Sequence: Synthetic oligonucleotide"
tggtcccgtgctggtggttgagg

SEQ ID NO: 1374 - DNA, 23 bp, Artificial Sequence
  source: /note="Description of Artificial Sequence: Synthetic oligonucleotide"
gtgctggtggttgaggatcctgg

SEQ ID NO: 1375 - DNA, 23 bp, Artificial Sequence
  source: /note="Description of Artificial Sequence: Synthetic oligonucleotide"
gtggttgaggatcctggaattag

SEQ ID NO: 1376 - DNA, 23 bp, Artificial Sequence
  source: /note="Description of Artificial Sequence: Synthetic oligonucleotide"
ggttgaggatcctggaattagag

SEQ ID NO: 1377 - DNA, 23 bp, Artificial Sequence
  source: /note="Description of Artificial Sequence: Synthetic oligonucleotide"
gttgaggatcctggaattagagg

SEQ ID NO: 1378 - DNA, 23 bp, Artificial Sequence
  source: /note="Description of Artificial Sequence: Synthetic oligonucleotide"
tcctggaattagaggacaaacgg

SEQ ID NO: 1379 - DNA, 23 bp, Artificial Sequence
  source: /note="Description of Artificial Sequence: Synthetic oligonucleotide"
cctggaattagaggacaaacggg

SEQ ID NO: 1380 - DNA, 23 bp, Artificial Sequence
  source: /note="Description of Artificial Sequence: Synthetic oligonucleotide"
aaacgggcaacataccttgatag

SEQ ID NO: 1381 - DNA, 23 bp, Artificial Sequence
  source: /note="Description of Artificial Sequence: Synthetic oligonucleotide"
ggcaacataccttgatagtccag

SEQ ID NO: 1382 - DNA, 23 bp, Artificial Sequence
  source: /note="Description of Artificial Sequence: Synthetic oligonucleotide"
aacataccttgatagtccagaag

SEQ ID NO: 1383 - DNA, 23 bp, Artificial Sequence
  source: /note="Description of Artificial Sequence: Synthetic oligonucleotide"
gatagtccagaagaaccaacaag

SEQ ID NO: 1384 - DNA, 23 bp, Artificial Sequence
  source: /note="Description of Artificial Sequence: Synthetic oligonucleotide"
agtccagaagaaccaacaagaag

SEQ ID NO: 1385 - DNA, 23 bp, Artificial Sequence
  source: /note="Description of Artificial Sequence: Synthetic oligonucleotide"
agaagaaccaacaagaagatgag

SEQ ID NO: 1386 - DNA, 23 bp, Artificial Sequence
  source: /note="Description of Artificial Sequence: Synthetic oligonucleotide"
gaagaaccaacaagaagatgagg

SEQ ID NO: 1387 - DNA, 23 bp, Artificial Sequence
  source: /note="Description of Artificial Sequence: Synthetic oligonucleotide"
accaacaagaagatgaggcatag

SEQ ID NO: 1388 - DNA, 23 bp, Artificial Sequence
  source: /note="Description of Artificial Sequence: Synthetic oligonucleotide"
aacaagaagatgaggcatagcag

SEQ ID NO: 1389 - DNA, 23 bp, Artificial Sequence
  source: /note="Description of Artificial Sequence: Synthetic oligonucleotide"
aagaagatgaggcatagcagcag

SEQ ID NO: 1390 - DNA, 23 bp, Artificial Sequence
  source: /note="Description of Artificial Sequence: Synthetic oligonucleotide"
agaagatgaggcatagcagcagg

SEQ ID NO: 1391 - DNA, 23 bp, Artificial Sequence
  source: /note="Description of Artificial Sequence: Synthetic oligonucleotide"
tgaggcatagcagcaggatgaag

SEQ ID NO: 1392 - DNA, 23 bp, Artificial Sequence
  source: /note="Description of Artificial Sequence: Synthetic oligonucleotide"
aggcatagcagcaggatgaagag

SEQ ID NO: 1393 - DNA, 23 bp, Artificial Sequence
  source: /note="Description of Artificial Sequence: Synthetic oligonucleotide"
ggcatagcagcaggatgaagagg

SEQ ID NO: 1394 - DNA, 23 bp, Artificial Sequence
  source: /note="Description of Artificial Sequence: Synthetic oligonucleotide"
atagcagcaggatgaagaggaag

SEQ ID NO: 1395 - DNA, 23 bp, Artificial Sequence
  source: /note="Description of Artificial Sequence: Synthetic oligonucleotide"
aggaagatgataaaacgccgcag

SEQ ID NO: 1396 - DNA, 23 bp, Artificial Sequence
  source: /note="Description of Artificial Sequence: Synthetic oligonucleotide"
taaaacgccgcagacacatccag

SEQ ID NO: 1397 - DNA, 23 bp, Artificial Sequence
  source: /note="Description of Artificial Sequence: Synthetic oligonucleotide"
cagacacatccagcgataaccag

SEQ ID NO: 1398 - DNA, 23 bp, Artificial Sequence
  source: /note="Description of Artificial Sequence: Synthetic oligonucleotide"
agacacatccagcgataaccagg

SEQ ID NO: 1399 - DNA, 23 bp, Artificial Sequence
  source: /note="Description of Artificial Sequence: Synthetic oligonucleotide"
catccagcgataaccaggacaag

SEQ ID NO: 1400 - DNA, 23 bp, Artificial Sequence
  source: /note="Description of Artificial Sequence: Synthetic oligonucleotide"
cagcgataaccaggacaagttgg

SEQ ID NO: 1401 - DNA, 23 bp, Artificial Sequence
  source: /note="Description of Artificial Sequence: Synthetic oligonucleotide"
gcgataaccaggacaagttggag

SEQ ID NO: 1402 - DNA, 23 bp, Artificial Sequence
  source: /note="Description of Artificial Sequence: Synthetic oligonucleotide"
cgataaccaggacaagttggagg

SEQ ID NO: 1403 - DNA, 23 bp, Artificial Sequence
  source: /note="Description of Artificial Sequence: Synthetic oligonucleotide"
aaccaggacaagttggaggacag

SEQ ID NO: 1404 - DNA, 23 bp, Artificial Sequence
  source: /note="Description of Artificial Sequence: Synthetic oligonucleotide"
accaggacaagttggaggacagg

SEQ ID NO: 1405 - DNA, 23 bp, Artificial Sequence
  source: /note="Description of Artificial Sequence: Synthetic oligonucleotide"
caggacaagttggaggacaggag

SEQ ID NO: 1406 - DNA, 23 bp, Artificial Sequence
  source: /note="Description of Artificial Sequence: Synthetic oligonucleotide"
aggacaagttggaggacaggagg

SEQ ID NO: 1407 - DNA, 23 bp, Artificial Sequence
  source: /note="Description of Artificial Sequence: Synthetic oligonucleotide"
caagttggaggacaggaggttgg

SEQ ID NO: 1408 - DNA, 23 bp, Artificial Sequence
  source: /note="Description of Artificial Sequence: Synthetic oligonucleotide"
ttggaggacaggaggttggtgag

SEQ ID NO: 1409 - DNA, 23 bp, Artificial Sequence
  source: /note="Description of Artificial Sequence: Synthetic oligonucleotide"
acaggaggttggtgagtgattgg

SEQ ID NO: 1410 - DNA, 23 bp, Artificial Sequence
  source: /note="Description of Artificial Sequence: Synthetic oligonucleotide"
aggaggttggtgagtgattggag

SEQ ID NO: 1411 - DNA, 23 bp, Artificial Sequence
  source: /note="Description of Artificial Sequence: Synthetic oligonucleotide"
ggaggttggtgagtgattggagg

SEQ ID NO: 1412 - DNA, 23 bp, Artificial Sequence
  source: /note="Description of Artificial Sequence: Synthetic oligonucleotide"
gttggtgagtgattggaggttgg

SEQ ID NO: 1413 - DNA, 23 bp, Artificial Sequence
  source: /note="Description of Artificial Sequence: Synthetic oligonucleotide"
ttggtgagtgattggaggttggg

SEQ ID NO: 1414 - DNA, 23 bp, Artificial Sequence
  source: /note="Description of Artificial Sequence: Synthetic oligonucleotide"
tggtgagtgattggaggttgggg

SEQ ID NO: 1415 - DNA, 23 bp, Artificial Sequence
  source: /note="Description of Artificial Sequence: Synthetic oligonucleotide"
aggttggggactgcgaattttgg

SEQ ID NO: 1416 - DNA, 23 bp, Artificial Sequence
  source: /note="Description of Artificial Sequence: Synthetic oligonucleotide"
ggggactgcgaattttggccaag

SEQ ID NO: 1417 - DNA, 23 bp, Artificial Sequence
  source: /note="Description of Artificial Sequence: Synthetic oligonucleotide"
cgaattttggccaagacacacgg

SEQ ID NO: 1418 - DNA, 23 bp, Artificial Sequence
  source: /note="Description of Artificial Sequence: Synthetic oligonucleotide"
attttggccaagacacacggtag

SEQ ID NO: 1419 - DNA, 23 bp, Artificial Sequence
  source: /note="Description of Artificial Sequence: Synthetic oligonucleotide"
agacacacggtagttccccctag

SEQ ID NO: 1420 - DNA, 23 bp, Artificial Sequence
  source: /note="Description of Artificial Sequence: Synthetic oligonucleotide"
gtagttccccctagaaaattgag

SEQ ID NO: 1421 - DNA, 23 bp, Artificial Sequence
  source: /note="Description of Artificial Sequence: Synthetic oligonucleotide"
agttccccctagaaaattgagag

SEQ ID NO: 1422 - DNA, 23 bp, Artificial Sequence
  source: /note="Description of Artificial Sequence: Synthetic oligonucleotide"
tccccctagaaaattgagagaag

SEQ ID NO: 1423 - DNA, 23 bp, Artificial Sequence
  source: /note="Description of Artificial Sequence: Synthetic oligonucleotide"
aattgagagaagtccaccacgag

SEQ ID NO: 1424 - DNA, 23 bp, Artificial Sequence
  source: /note="Description of Artificial Sequence: Synthetic oligonucleotide"
agagaagtccaccacgagtctag

SEQ ID NO: 1425 - DNA, 23 bp, Artificial Sequence
  source: /note="Description of Artificial Sequence: Synthetic oligonucleotide"
caccacgagtctagactctgcgg

SEQ ID NO: 1426 - DNA, 23 bp, Artificial Sequence
  source: /note="Description of Artificial Sequence: Synthetic oligonucleotide"
tctagactctgcggtattgtgag

SEQ ID NO: 1427 - DNA, 23 bp, Artificial Sequence
  source: /note="Description of Artificial Sequence: Synthetic oligonucleotide"
ctagactctgcggtattgtgagg

SEQ ID NO: 1428 - DNA, 23 bp, Artificial Sequence
  source: /note="Description of Artificial Sequence: Synthetic oligonucleotide"
ttgtgaggattcttgtcaacaag

SEQ ID NO: 1429 - DNA, 23 bp, Artificial Sequence
  source: /note="Description of Artificial Sequence: Synthetic oligonucleotide"
aaaaaccccgcctgtaacacgag

SEQ ID NO: 1430 - DNA, 23 bp, Artificial Sequence
  source: /note="Description of Artificial Sequence: Synthetic oligonucleotide"
aaccccgcctgtaacacgagaag

SEQ ID NO: 1431 - DNA, 23 bp, Artificial Sequence
  source: /note="Description of Artificial Sequence: Synthetic oligonucleotide"
accccgcctgtaacacgagaagg

SEQ ID NO: 1432 - DNA, 23 bp, Artificial Sequence
  source: /note="Description of Artificial Sequence: Synthetic oligonucleotide"
ccccgcctgtaacacgagaaggg

SEQ ID NO: 1433 - DNA, 23 bp, Artificial Sequence
  source: /note="Description of Artificial Sequence: Synthetic oligonucleotide"
cccgcctgtaacacgagaagggg

SEQ ID NO: 1434 - DNA, 23 bp, Artificial Sequence
  source: /note="Description of Artificial Sequence: Synthetic oligonucleotide"
tgtaacacgagaaggggtcctag

SEQ ID NO: 1435 - DNA, 23 bp, Artificial Sequence
  source: /note="Description of Artificial Sequence: Synthetic oligonucleotide"
gtaacacgagaaggggtcctagg

SEQ ID NO: 1436 - DNA, 23 bp, Artificial Sequence
  source: /note="Description of Artificial Sequence: Synthetic oligonucleotide"
gatgtgatgttctccatgttcag

SEQ ID NO: 1437 - DNA, 23 bp, Artificial Sequence
  source: /note="Description of Artificial Sequence: Synthetic oligonucleotide"
gatgttctccatgttcagcgcag

SEQ ID NO: 1438 - DNA, 23 bp, Artificial Sequence
  source: /note="Description of Artificial Sequence: Synthetic oligonucleotide"
atgttctccatgttcagcgcagg

SEQ ID NO: 1439 - DNA, 23 bp, Artificial Sequence
  source: /note="Description of Artificial Sequence: Synthetic oligonucleotide"
tgttctccatgttcagcgcaggg

SEQ ID NO: 1440 - DNA, 23 bp, Artificial Sequence
  source: /note="Description of Artificial Sequence: Synthetic oligonucleotide"
gcgcagggtccccaatcctcgag

SEQ ID NO: 1441 - DNA, 23 bp, Artificial Sequence
  source: /note="Description of Artificial Sequence: Synthetic oligonucleotide"
cagggtccccaatcctcgagaag

SEQ ID NO: 1442 - DNA, 23 bp, Artificial Sequence
  source: /note="Description of Artificial Sequence: Synthetic oligonucleotide"
tcctcgagaagattgacgataag

SEQ ID NO: 1443 - DNA, 23 bp, Artificial Sequence
  source: /note="Description of Artificial Sequence: Synthetic oligonucleotide"
cctcgagaagattgacgataagg

SEQ ID NO: 1444 - DNA, 23 bp, Artificial Sequence
  source: /note="Description of Artificial Sequence: Synthetic oligonucleotide"
ctcgagaagattgacgataaggg

SEQ ID NO: 1445 - DNA, 23 bp, Artificial Sequence
  source: /note="Description of Artificial Sequence: Synthetic oligonucleotide"
cgagaagattgacgataagggag

SEQ ID NO: 1446 - DNA, 23 bp, Artificial Sequence
  source: /note="Description of Artificial Sequence: Synthetic oligonucleotide"
agaagattgacgataagggagag

SEQ ID NO: 1447 - DNA, 23 bp, Artificial Sequence
  source: /note="Description of Artificial Sequence: Synthetic oligonucleotide"
gaagattgacgataagggagagg

SEQ ID NO: 1448 - DNA, 23 bp, Artificial Sequence
  source: /note="Description of Artificial Sequence: Synthetic oligonucleotide"
gattgacgataagggagaggcag

SEQ ID NO: 1449 - DNA, 23 bp, Artificial Sequence
  source: /note="Description of Artificial Sequence: Synthetic oligonucleotide"
tgacgataagggagaggcagtag

SEQ ID NO: 1450 - DNA, 23 bp, Artificial Sequence
  source: /note="Description of Artificial Sequence: Synthetic oligonucleotide"
gataagggagaggcagtagtcgg

SEQ ID NO: 1451 - DNA, 23 bp, Artificial Sequence
  source: /note="Description of Artificial Sequence: Synthetic oligonucleotide"
gggagaggcagtagtcggaacag

SEQ ID NO: 1452 - DNA, 23 bp, Artificial Sequence
  source: /note="Description of Artificial Sequence: Synthetic oligonucleotide"
ggagaggcagtagtcggaacagg

SEQ ID NO: 1453 - DNA, 23 bp, Artificial Sequence
  source: /note="Description of Artificial Sequence: Synthetic oligonucleotide"
gagaggcagtagtcggaacaggg

SEQ ID NO: 1454 - DNA, 23 bp, Artificial Sequence
  source: /note="Description of Artificial Sequence: Synthetic oligonucleotide"
agggtttactgctcctgaactgg

SEQ ID NO: 1455 - DNA, 23 bp, Artificial Sequence
  source: /note="Description of Artificial Sequence: Synthetic oligonucleotide"
ggtttactgctcctgaactggag

SEQ ID NO: 1456 - DNA, 23 bp, Artificial Sequence
  source: /note="Description of Artificial Sequence: Synthetic oligonucleotide"
tgctcctgaactggagccaccag

SEQ ID NO: 1457 - DNA, 23 bp, Artificial Sequence
  source: /note="Description of Artificial Sequence: Synthetic oligonucleotide"
tcctgaactggagccaccagcag

SEQ ID NO: 1458 - DNA, 23 bp, Artificial Sequence
  source: /note="Description of Artificial Sequence: Synthetic oligonucleotide"
cctgaactggagccaccagcagg

SEQ ID NO: 1459 - DNA, 23 bp, Artificial Sequence
  source: /note="Description of Artificial Sequence: Synthetic oligonucleotide"
ctgaactggagccaccagcaggg

SEQ ID NO: 1460 - DNA, 23 bp, Artificial Sequence
  source: /note="Description of Artificial Sequence: Synthetic oligonucleotide"
gagccaccagcagggaaatacag

SEQ ID NO: 1461 - DNA, 23 bp, Artificial Sequence
  source: /note="Description of Artificial Sequence: Synthetic oligonucleotide"
agccaccagcagggaaatacagg

SEQ ID NO: 1462 - DNA, 23 bp, Artificial Sequence
  source: /note="Description of Artificial Sequence: Synthetic oligonucleotide"
gaaatacaggcctctcactctgg

SEQ ID NO: 1463 - DNA, 23 bp, Artificial Sequence
  source: /note="Description of Artificial Sequence: Synthetic oligonucleotide"
aaatacaggcctctcactctggg

SEQ ID NO: 1464 - DNA, 23 bp, Artificial Sequence
  source: /note="Description of Artificial Sequence: Synthetic oligonucleotide"
cctctcactctgggatcttgcag

SEQ ID NO: 1465 - DNA, 23 bp, Artificial Sequence
  source: /note="Description of Artificial Sequence: Synthetic oligonucleotide"
tctcactctgggatcttgcagag

SEQ ID NO: 1466 - DNA, 23 bp, Artificial Sequence
  source: /note="Description of Artificial Sequence: Synthetic oligonucleotide"
ctctgggatcttgcagagtttgg

SEQ ID NO: 1467 - DNA, 23 bp, Artificial Sequence
  source: /note="Description of Artificial Sequence: Synthetic oligonucleotide"
gatcttgcagagtttggtgaaag

SEQ ID NO: 1468 - DNA, 23 bp, Artificial Sequence
  source: /note="Description of Artificial Sequence: Synthetic oligonucleotide"
atcttgcagagtttggtgaaagg

SEQ ID NO: 1469 - DNA, 23 bp, Artificial Sequence
  source: /note="Description of Artificial Sequence: Synthetic oligonucleotide"
cagagtttggtgaaaggttgtgg

SEQ ID NO: 1470 - DNA, 12 bp, Artificial Sequence
  source: /note="Description of Artificial Sequence: Synthetic oligonucleotide"
gttttagagcta

SEQ ID NO: 1471 - DNA, 31 bp, Artificial Sequence
  source: /note="Description of Artificial Sequence: Synthetic oligonucleotide"
tagcaagttaaaataaggctagtccgttttt

SEQ ID NO: 1472 - DNA, 19 bp, Artificial Sequence
  source: /note="Description of Artificial Sequence: Synthetic oligonucleotide"
cctctgccgatccatactg

SEQ ID NO: 1473 - DNA, 33 bp, Homo sapiens
ggacatcgatgtcacctccaatgactagggtgg

SEQ ID NO: 1474 - DNA, 33 bp, Homo sapiens
cattggaggtgacatcgatgtcctccccattgg

SEQ ID NO: 1475 - DNA, 33 bp, Homo sapiens
ggaagggcctgagtccgagcagaagaagaaggg

SEQ ID NO: 1476 - DNA, 33 bp, Homo sapiens
ggtggcgagaggggccgagattgggtgttcagg

SEQ ID NO: 1477 - DNA, 33 bp, Homo sapiens
atgcaggagggtggcgagaggggccgagattgg

SEQ ID NO: 1478 - DNA, 32 bp, Artificial Sequence
  source: /note="Description of Artificial Sequence: Synthetic primer"
aaactctagagagggcctatttcccatgattc

SEQ ID NO: 1479 - DNA, 153 bp, Artificial Sequence
  source: /note="Description of Artificial Sequence: Synthetic primer"
acctctagaaaaaaagcaccgactcggtgccactttttcaagttgataacggactagccttattttaacttgctatgctgttttgtttccaaaacagcatagctctaaaacccctagtcattggaggtgacggtgtttcgtcctttccacaag

SEQ ID NO: 1480 - DNA, 52 bp, Artificial Sequence
  source: /note="Description of Artificial Sequence: Synthetic primer"
taatacgactcactataggaagtgcgccaccatggccccaaagaagaagcgg

SEQ ID NO: 1481 - DNA, 60 bp, Artificial Sequence
  source: /note="Description of Artificial Sequence: Synthetic primer"
ggttttttttttttttttttttttttttttttttcttactttttcttttttgcctggccg

SEQ ID NO: 1482 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 1483 - DNA, 91 bp, Artificial Sequence
  source: /note="Description of Artificial Sequence: Synthetic oligonucleotide"
tataatctcataagaaatttaaaaagggactaaaataaagagtttgcgggactctgcggggttacaatcccctaaaaccgcttttaaaatt

SEQ ID NO: 1484 - DNA, 36 bp, Artificial Sequence
  source: /note="Description of Artificial Sequence: Synthetic oligonucleotide"
attttaccataaagaaatttaaaaagggactaaaac

SEQ ID NO: 1485 - RNA, 95 nt, Artificial Sequence
  source: /note="Description of Artificial Sequence: Synthetic oligonucleotide"
  modified_base (1)..(20): a, c, u, g, unknown or other
nnnnnnnnnnnnnnnnnnnnguuuuagucccgaaagggacuaaaauaaagaguuugcgggacucugcgggguuacaauccccuaaaaccgcuuuu

SEQ ID NO: 1486 - protein, 1115 aa, Artificial Sequence
  source: /note="Description of Artificial Sequence: Synthetic polypeptide"
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1487 - protein, 1374 aa, Artificial Sequence
  source: /note="Description of Artificial Sequence: Synthetic polypeptide"
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 1488 - protein, 6 aa, Artificial Sequence
  source: /note="Description of Artificial Sequence: Synthetic 6xHis tag"
HHHHHH

SEQ ID NO: 1489 - DNA, 23 bp, Artificial Sequence
  source: /note="Description of Artificial Sequence: Synthetic oligonucleotide"
gccaaattggacgaccctcgcgg

SEQ ID NO: 1490 - DNA, 23 bp, Artificial Sequence
  source: /note="Description of Artificial Sequence: Synthetic oligonucleotide"
cgaggagacccccgtttcggtgg

SEQ ID NO: 1491 - DNA, 23 bp, Artificial Sequence
  source: /note="Description of Artificial Sequence: Synthetic oligonucleotide"
cccgccgccgccgtggctcgagg

SEQ ID NO: 1492 - DNA, 23 bp, Artificial Sequence
  source: /note="Description of Artificial Sequence: Synthetic oligonucleotide"
tgagctctacgagatccacaagg

SEQ ID NO: 1493 - DNA, 23 bp, Artificial Sequence
  source: /note="Description of Artificial Sequence: Synthetic oligonucleotide"
ctcaaaattcataccggttgtgg

SEQ ID NO: 1494 - DNA, 23 bp, Artificial Sequence
  source: /note="Description of Artificial Sequence: Synthetic oligonucleotide"
cgttaaacaacaaccggacttgg

SEQ ID NO: 1495 - DNA, 23 bp, Artificial Sequence
  source: /note="Description of Artificial Sequence: Synthetic oligonucleotide"
ttcaccccgcggcgctgaatggg

SEQ ID NO: 1496 - DNA, 23 bp, Artificial Sequence
  source: /note="Description of Artificial Sequence: Synthetic oligonucleotide"
accactaccagtccgtccacagg

SEQ ID NO: 1497 - DNA, 20 bp, Homo sapiens
acccttgttagccacctccc

SEQ ID NO: 1498 - DNA, 20 bp, Homo sapiens
gaacgcagtgctcttcgaag

SEQ ID NO: 1499 - DNA, 20 bp, Homo sapiens
ctcacgccctgctccgtgta

SEQ ID NO: 1500 - DNA, 20 bp, Homo sapiens
ggcgacaactacttcctggt

SEQ ID NO: 1501 - DNA, 20 bp, Homo sapiens
ctcacgccctgctccgtgta

SEQ ID NO: 1502 - DNA, 20 bp, Homo sapiens
gggcgacaactacttcctgg

SEQ ID NO: 1503 - DNA, 20 bp, Homo sapiens
cctcttcagggccggggtgg

SEQ ID NO: 1504 - DNA, 20 bp, Homo sapiens
gaggacccaggtggaactgc

SEQ ID NO: 1505 - DNA, 20 bp, Homo sapiens
tcagctccaggcggtcctgg

SEQ ID NO: 1506 - DNA, 20 bp, Homo sapiens
agcagcagcagcagtggcag

SEQ ID NO: 1507 - DNA, 20 bp, Homo sapiens
tgggcaccgtcagctccagg

SEQ ID NO: 1508 - DNA, 20 bp, Homo sapiens
cagcagtggcagcggccacc

SEQ ID NO: 1509 - DNA, 20 bp, Homo sapiens
acctctcccctggccctcat

SEQ ID NO: 1510 - DNA, 20 bp, Homo sapiens
ccaggaccgcctggagctga

SEQ ID NO: 1511 - DNA, 20 bp, Homo sapiens
ccgtcagctccaggcggtcc

SEQ ID NO: 1512 - DNA, 20 bp, Homo sapiens
agcagcagcagcagtggcag

SEQ ID NO: 1513 - DNA, 20 bp, Homo sapiens
atgtgccaagcaaagcctca

SEQ ID NO: 1514 - DNA, 20 bp, Homo sapiens
ttcggtcatgcccgtggatg

SEQ ID NO: 1515 - DNA, 20 bp, Homo sapiens
gtcgttgaaattcatcgtac

SEQ ID NO: 1516 - DNA, 20 bp, Homo sapiens
accacctgtgaagagtttcc

SEQ ID NO: 1517 - DNA, 20 bp, Homo sapiens
cgtcgttgaaattcatcgta

SEQ ID NO: 1518 - DNA, 20 bp, Homo sapiens
accacctgtgaagagtttcc

SEQ ID NO: 1519 - DNA, 20 bp, Mus musculus
gaacgcagtgcttttcgagg

SEQ ID NO: 1520 - DNA, 20 bp, Mus musculus
acccttgttggccacctccc

SEQ ID NO: 1521 - DNA, 20 bp, Mus musculus
ggtgacaactactatctggt

SEQ ID NO: 1522 - DNA, 20 bp, Mus musculus
ctcacaccctgctccgtgta

SEQ ID NO: 1523 - DNA, 20 bp, Mus musculus
gggtgacaactactatctgg

SEQ ID NO: 1524 - DNA, 20 bp, Mus musculus
ctcacaccctgctccgtgta

SEQ ID NO: 1525 - DNA, 20 bp, Mus musculus
cgagaacgcagtgcttttcg

SEQ ID NO: 1526 - DNA, 20 bp, Mus musculus
acccttgttggccacctccc

SEQ ID NO: 1527 - DNA, 20 bp, Mus musculus
atgagccaagcaaatcctca

SEQ ID NO: 1528 - DNA, 20 bp, Mus musculus
ttccgtcatgcccgtggaca

SEQ ID NO: 1529 - DNA, 20 bp, Mus musculus
cttcgttgaaaaccattgta

SEQ ID NO: 1530 - DNA, 20 bp, Mus musculus
ccacctctgaagagtttcct

SEQ ID NO: 1531 - DNA, 20 bp, Mus musculus
cttcgttgaaaaccattgta

SEQ ID NO: 1532 - DNA, 20 bp, Mus musculus
accacctctgaagagtttcc

SEQ ID NO: 1533 - DNA, 20 bp, Mus musculus
cttccactcactctgcgatt

SEQ ID NO: 1534 - DNA, 20 bp, Mus musculus
accatgtctcagtgtcaagc

SEQ ID NO: 1535 - DNA, 20 bp, Mus musculus
ggcggcaacagcggcaacag

SEQ ID NO: 1536 - DNA, 20 bp, Mus musculus
actgctctgcgtggctgcgg

SEQ ID NO: 1537 - DNA, 20 bp, Mus musculus
ccgcagccacgcagagcagt

SEQ ID NO: 1538 - DNA, 20 bp, Mus musculus
gcacctctcctcgccccgat

SEQ ID NO: 1539 - DNA, 23 bp, Artificial Sequence
  source: /note="Description of Artificial Sequence: Synthetic primer"
gagggcctatttcccatgattcc

SEQ ID NO: 1540 - DNA, 126 bp, Artificial Sequence
  source: /note="Description of Artificial Sequence: Synthetic primer"
  modified_base (84)..(102): a, c, t, g, unknown or other
aaaaaaagcaccgactcggtgccactttttcaagttgataacggactagccttattttaacttgctatttctagctctaaaacnnnnnnnnnnnnnnnnnnnccggtgtttcgtcctttccacaag

SEQ ID NO: 1541 - DNA, 24 bp, Artificial Sequence
  source: /note="Description of Artificial Sequence: Synthetic primer"
  modified_base (6)..(24): a, c, t, g, unknown or other
caccgnnnnnnnnnnnnnnnnnnn

SEQ ID NO: 1542 - DNA, 24 bp, Artificial Sequence
  source: /note="Description of Artificial Sequence: Synthetic primer"
  modified_base (5)..(23): a, c, t, g, unknown or other
aaacnnnnnnnnnnnnnnnnnnnc

SEQ ID NO: 1543 - DNA, 126 bp, Artificial Sequence
  source: /note="Description of Artificial Sequence: Synthetic primer"
aaaaaaagcaccgactcggtgccactttttcaagttgataacggactagccttattttaacttgctatttctagctctaaaacccctagtcattggaggtgaccggtgtttcgtcctttccacaag

SEQ ID NO: 1544 - DNA, 24 bp, Artificial Sequence
  source: /note="Description of Artificial Sequence: Synthetic primer"
caccgtcacctccaatgactaggg

SEQ ID NO: 1545 - DNA, 24 bp, Artificial Sequence
  source: /note="Description of Artificial Sequence: Synthetic primer"
aaacccctagtcattggaggtgac

SEQ ID NO: 1546 - DNA, 192 bp, Artificial Sequence
  source: /note="Description of Artificial Sequence: Synthetic primer"
cagaagaagaagggctcccatcacatcaaccggtggcgcattgccacgaagcaggccaatggggaggacatcgatgtcacctccaatgacaagcttgctagcggtgggcaaccacaaacccacgagggcagagtgctgcttgctgctggccaggcccctgcgtgggcccaagctggactctggccactccct

SEQ ID NO: 1547 - DNA, 192 bp, Artificial Sequence
  source: /note="Description of Artificial Sequence: Synthetic primer"
agggagtggccagagtccagcttgggcccacgcaggggcctggccagcagcaagcagcactctgccctcgtgggtttgtggttgcccaccgctagcaagcttgtcattggaggtgacatcgatgtcctccccattggcctgcttcgtggcaatgcgccaccggttgatgtgatgggagcccttcttcttctg

SEQ ID NO: 1548 - DNA, 20 bp, Artificial Sequence
  source: /note="Description of Artificial Sequence: Synthetic primer"
ccatccccttctgtgaatgt

SEQ ID NO: 1549 - DNA, 20 bp, Artificial Sequence
  source: /note="Description of Artificial Sequence: Synthetic primer"
ggagattggagacacggaga

SEQ ID NO: 1550 - DNA, 20 bp, Artificial Sequence
  source: /note="Description of Artificial Sequence: Synthetic primer"
ggctccctgggttcaaagta

SEQ ID NO: 1551 - DNA, 21 bp, Artificial Sequence
  source: /note="Description of Artificial Sequence: Synthetic primer"
agaggggtctggatgtcgtaa

SEQ ID NO: 1552 - DNA, 24 bp, Artificial Sequence
  source: /note="Description of Artificial Sequence: Synthetic primer"
cgccagggttttcccagtcacgac

SEQ ID NO: 1553 - DNA, 51 bp, Artificial Sequence
  source: /note="Description of Artificial Sequence: Synthetic primer"
gagggtctcgtccttgcggccgcgctagcgagggcctatttcccatgattc

SEQ ID NO: 1554 - DNA, 133 bp, Artificial Sequence
  source: /note="Description of Artificial Sequence: Synthetic primer"
  modified_base (95)..(114): a, c, t, g, unknown or other
ctcggtctcggtaaaaaagcaccgactcggtgccactttttcaagttgataacggactagccttattttaacttgctatttctagctctaaaacnnnnnnnnnnnnnnnnnnnnggtgtttcgtcctttccac

SEQ ID NO: 1555 - DNA, 41 bp, Artificial Sequence
  source: /note="Description of Artificial Sequence: Synthetic primer"
gagggtctctttaccggtgagggcctatttcccatgattcc

SEQ ID NO: 1556 - DNA, 133 bp, Artificial Sequence
  source: /note="Description of Artificial Sequence: Synthetic primer"
  modified_base (95)..(114): a, c, t, g, unknown or other
ctcggtctcctcaaaaaagcaccgactcggtgccactttttcaagttgataacggactagccttattttaacttgctatttctagctctaaaacnnnnnnnnnnnnnnnnnnnnggtgtttcgtcctttccac

SEQ ID NO: 1557 - DNA, 40 bp, Artificial Sequence
  source: /note="Description of Artificial Sequence: Synthetic primer"
gagggtctctttgagctcgagggcctatttcccatgattc

SEQ ID NO: 1558 - DNA, 133 bp, Artificial Sequence
  source: /note="Description of Artificial Sequence: Synthetic primer"
  modified_base (96)..(115): a, c, t, g, unknown or other
ctcggtctcgcgtaaaaaagcaccgactcggtgccactttttcaagttgataacggactagccttattttaacttgctatttctagctctaaaacnnnnnnnnnnnnnnnnnnnnggtgtttcgtcctttcca

SEQ ID NO: 1559 - DNA, 27 bp, Artificial Sequence
  source: /note="Description of Artificial Sequence: Synthetic primer"
gagggtctcttacgcgtgtgtctagac

SEQ ID NO: 1560 - DNA, 98 bp, Artificial Sequence
  source: /note="Description of Artificial Sequence: Synthetic primer"
ctcggtctcaaggacagggaagggagcagtggttcacgcctgtaatcccagcaatttgggaggccaaggtgggtagatcacctgagattaggagttgc

SEQ ID NO: 1561 - DNA, 30 bp, Artificial Sequence
  source: /note="Description of Artificial Sequence: Synthetic primer"
cctgtccttgcggccgcgctagcgagggcc

SEQ ID NO: 1562 - DNA, 31 bp, Artificial Sequence
  source: /note="Description of Artificial Sequence: Synthetic primer"
cacgcggccgcaaggacagggaagggagcag

SEQ ID NO: 1563 - protein, 327 aa, Artificial Sequence
  source: /note="Description of Artificial Sequence: Synthetic polypeptide"
MVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYKSGLRSREEEEETDSRMPHLDSPGSSQPRRSFLSRVIRAALPLQLLLLLLLLLACLLPASEDDYSCTQANNFARSFYPMLRYTNGPPPT

SEQ ID NO: 1564 - DNA, 3243 bp, Artificial Sequence
  source: /note="Description of Artificial Sequence: Synthetic polynucleotide"
accggtgccaccatgtacccatacgatgttccagattacgcttcgccgaagaaaaagcgcaaggtcgaagcgtccatgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggctaagaattc

SEQ ID NO: 1565 - DNA, 20 bp, Artificial Sequence
  source: /note="Description of Artificial Sequence: Synthetic oligonucleotide"
ggggcgcacctctctttacg

SEQ ID NO: 1566 - DNA, 20 bp, Artificial Sequence
  source: /note="Description of Artificial Sequence: Synthetic oligonucleotide"
taaagaatttggagctactg

SEQ ID NO: 1567 - DNA, 20 bp, Artificial Sequence
  source: /note="Description of Artificial Sequence: Synthetic oligonucleotide"
tcctctgccgatccatactg

SEQ ID NO: 1568 - DNA, 17 bp, Artificial Sequence
  source: /note="Description of Artificial Sequence: Synthetic primer"
tgcacttcgcttcacct

SEQ ID NO: 1569 - DNA, 17 bp, Artificial Sequence
  source: /note="Description of Artificial Sequence: Synthetic primer"
aggggcatttggtggtc

SEQ ID NO: 1570 - DNA, 21 bp, Artificial Sequence
  source: /note="Description of Artificial Sequence: Synthetic primer"
ccgtctgtgccttctcatctg

SEQ ID NO: 1571 - DNA, 29 bp, Artificial Sequence
  source: /note="Description of Artificial Sequence: Synthetic primer"
agtccaagagtcctcttatgtaagacctt

SEQ ID NO: 1572 - DNA, 26 bp, Artificial Sequence
  source: /note="Description of Artificial Sequence: Synthetic probe"
  source: /note="5' Fluorescein"
  misc_feature (9)..(10): /note="Nucleotides at these positions are non-consecutive and are seperated by an internal ZEN quencher"
  source: /note="3' Iowa Black FQ quencher"
ccgtgtgcacttcgcttcacctctgc

SEQ ID NO: 1573 - DNA, 20 bp, Artificial Sequence
  source: /note="Description of Artificial Sequence: Synthetic primer"
tatccatggctgctaggctg

SEQ ID NO: 1574 - DNA, 22 bp, Artificial Sequence
  source: /note="Description of Artificial Sequence: Synthetic primer"
agtcagaaggcaaaaacgagag

SEQ ID NO: 1575 - DNA, 20 bp, Artificial Sequence
  source: /note="Description of Artificial Sequence: Synthetic primer"
aaattggtctgcgcaccagc

SEQ ID NO: 1576 - DNA, 24 bp, Artificial Sequence
  source: /note="Description of Artificial Sequence: Synthetic primer"
aggtctctagatgctggatcttcc

SEQ ID NO: 1577 - DNA, 21 bp, Artificial Sequence
  source: /note="Description of Artificial Sequence: Synthetic primer"
ggttatcctgcgttaatgccc

SEQ ID NO: 1578 - DNA, 19 bp, Artificial Sequence
  source: /note="Description of Artificial Sequence: Synthetic primer"
gtccgcgtaaagagaggtg

SEQ ID NO: 1579 - DNA, 21 bp, Artificial Sequence
  source: /note="Description of Artificial Sequence: Synthetic primer"
tgaacctttaccccgttgccc

SEQ ID NO: 1580 - DNA, 20 bp, Artificial Sequence
  source: /note="Description of Artificial Sequence: Synthetic primer"
agagagtcccaagcgacccc

SEQ ID NO: 1581 - DNA, 102 bp, Artificial Sequence
  source: /note="Description of Artificial Sequence: Synthetic polynucleotide"
gttttagagctatgctgttttgaatggtcccaaaacggaagggcctgagtccgagcagaagaagaagttttagagctatgctgttttgaatggtcccaaaac

SEQ ID NO: 1582 - DNA, 100 bp, Homo sapiens
cggaggacaaagtacaaacggcagaagctggaggaggaagggcctgagtccgagcagaagaagaagggctcccatcacatcaaccggtggcgcattgcca

SEQ ID NO: 1583 - DNA, 50 bp, Artificial Sequence
  source: /note="Description of Artificial Sequence: Synthetic oligonucleotide"
agctggaggaggaagggcctgagtccgagcagaagaagaagggctcccac

SEQ ID NO: 1584 - RNA, 30 nt, Artificial Sequence
  source: /note="Description of Artificial Sequence: Synthetic oligonucleotide"
gaguccgagcagaagaagaaguuuuagagc

SEQ ID NO: 1585 - DNA, 49 bp, Artificial Sequence
  source: /note="Description of Artificial Sequence: Synthetic oligonucleotide"
agctggaggaggaagggcctgagtccgagcagaagagaagggctcccat

SEQ ID NO: 1586 - DNA, 53 bp, Homo sapiens
ctggaggaggaagggcctgagtccgagcagaagaagaagggctcccatcacat

SEQ ID NO: 1587 - DNA, 52 bp, Homo sapiens
ctggaggaggaagggcctgagtccgagcagaagagaagggctcccatcacat

SEQ ID NO: 1588 - DNA, 54 bp, Homo sapiens
ctggaggaggaagggcctgagtccgagcagaagaaagaagggctcccatcacat

SEQ ID NO: 1589 - DNA, 50 bp, Homo sapiens
ctggaggaggaagggcctgagtccgagcagaagaagggctcccatcacat

SEQ ID NO: 1590 - DNA, 47 bp, Homo sapiens
ctggaggaggaagggcctgagcccgagcagaagggctcccatcacat

SEQ ID NO: 1591 - DNA, 48 bp, Homo sapiens
ctggaggaggaagggcctgagtccgagcagaagaagaagggctcccat

SEQ ID NO: 1592 - RNA, 20 nt, Artificial Sequence
  source: /note="Description of Artificial Sequence: Synthetic oligonucleotide"
gaguccgagcagaagaagau

SEQ ID NO: 1593 - RNA, 20 nt, Artificial Sequence
  source: /note="Description of Artificial Sequence: Synthetic oligonucleotide"
gaguccgagcagaagaagua

SEQ ID NO: 1594 - RNA, 20 nt, Artificial Sequence
  source: /note="Description of Artificial Sequence: Synthetic oligonucleotide"
gaguccgagcagaagaacaa

SEQ ID NO: 1595 - RNA, 20 nt, Artificial Sequence
  source: /note="Description of Artificial Sequence: Synthetic oligonucleotide"
gaguccgagcagaagaugaa

SEQ ID NO: 1596 - RNA, 20 nt, Artificial Sequence
  source: /note="Description of Artificial Sequence: Synthetic oligonucleotide"
gaguccgagcagaaguagaa

SEQ ID NO: 1597 - RNA, 20 nt, Artificial Sequence
  source: /note="Description of Artificial Sequence: Synthetic oligonucleotide"
gaguccgagcagaugaagaa

SEQ ID NO: 1598 - RNA, 20 nt, Artificial Sequence
  source: /note="Description of Artificial Sequence: Synthetic oligonucleotide"
gaguccgagcacaagaagaa

SEQ ID NO: 1599 - RNA, 20 nt, Artificial Sequence
  source: /note="Description of Artificial Sequence: Synthetic oligonucleotide"
gaguccgaggagaagaagaa

SEQ ID NO: 1600 - RNA, 20 nt, Artificial Sequence
  source: /note="Description of Artificial Sequence: Synthetic oligonucleotide"
gaguccgugcagaagaagaa

SEQ ID NO: 1601 - RNA, 20 nt, Artificial Sequence
  source: /note="Description of Artificial Sequence: Synthetic oligonucleotide"
gagucggagcagaagaagaa

SEQ ID NO: 1602 - DNA, 20 bp, Artificial Sequence
  source: /note="Description of Artificial Sequence: Synthetic oligonucleotide"
gagaccgagcagaagaagaa

SEQ ID NO: 1603 - DNA, 24 bp, Artificial Sequence
  source: /note="Description of Artificial Sequence: Synthetic oligonucleotide"
aatgacaagcttgctagcggtggg

SEQ ID NO: 1604 - DNA, 39 bp, Artificial Sequence
  source: /note="Description of Artificial Sequence: Synthetic oligonucleotide"
aaaacggaagggcctgagtccgagcagaagaagaagttt

SEQ ID NO: 1605 - DNA, 39 bp, Artificial Sequence
  source: /note="Description of Artificial Sequence: Synthetic oligonucleotide"
aaacaggggccgagattgggtgttcagggcagaggtttt

SEQ ID NO: 1606 - DNA, 38 bp, Artificial Sequence
  source: /note="Description of Artificial Sequence: Synthetic oligonucleotide"
aaaacggaagggcctgagtccgagcagaagaagaagtt

SEQ ID NO: 1607 - DNA, 40 bp, Artificial Sequence
  source: /note="Description of Artificial Sequence: Synthetic oligonucleotide"
aacggagggaggggcacagatgagaaactcagggttttag

SEQ ID NO: 1608 - DNA, 38 bp, Homo sapiens
agcccttcttcttctgctcggactcaggcccttcctcc

SEQ ID NO: 1609 - DNA, 40 bp, Homo sapiens
cagggagggaggggcacagatgagaaactcaggaggcccc

SEQ ID NO: 1610 - DNA, 80 bp, Artificial Sequence
  source: /note="Description of Artificial Sequence: Synthetic oligonucleotide"
ggcaatgcgccaccggttgatgtgatgggagcccttctaggaggcccccagagcagccactggggcctcaacactcaggc

SEQ ID NO: 1611 - DNA, 33 bp, Homo sapiens; identical to SEQ ID NO: 1475

SEQ ID NO: 1612 - DNA, 33 bp, Homo sapiens; identical to SEQ ID NO: 1474

SEQ ID NO: 1613 - DNA, 33 bp, Homo sapiens; identical to SEQ ID NO: 1473

SEQ ID NO: 1614 - DNA, 33 bp, Homo sapiens
catcgatgtcctccccattggcctgcttcgtgg

SEQ ID NO: 1615 - DNA, 33 bp, Homo sapiens
ttcgtggcaatgcgccaccggttgatgtgatgg

SEQ ID NO: 1616 - DNA, 33 bp, Homo sapiens
tcgtggcaatgcgccaccggttgatgtgatggg

SEQ ID NO: 1617 - DNA, 33 bp, Homo sapiens
tccagcttctgccgtttgtactttgtcctccgg

SEQ ID NO: 1618 - DNA, 33 bp, Homo sapiens
ggagggaggggcacagatgagaaactcaggagg

SEQ ID NO: 1619 - DNA, 33 bp, Homo sapiens
aggggccgagattgggtgttcagggcagagagg

SEQ ID NO: 1620 - DNA, 33 bp, Homo sapiens; identical to SEQ ID NO: 1477

SEQ ID NO: 1621 - DNA, 33 bp, Homo sapiens; identical to SEQ ID NO: 1476

SEQ ID NO: 1622 - DNA, 33 bp, Mus musculus
caagcactgagtgccattagctaaatgcatagg

SEQ ID NO: 1623 - DNA, 33 bp, Mus musculus
aatgcatagggtaccacccacaggtgccagggg

SEQ ID NO: 1624 - DNA, 33 bp, Mus musculus
acacacatgggaaagcctctgggccaggaaagg

SEQ ID NO: 1625 - DNA, 37 bp, Homo sapiens
ggaggaggtagtatacagaaacacagagaagtagaat

SEQ ID NO: 1626 - DNA, 37 bp, Homo sapiens
agaatgtagaggagtcacagaaactcagcactagaaa

SEQ ID NO: 1627 - DNA, 98 bp, Artificial Sequence
  source: /note="Description of Artificial Sequence: Synthetic oligonucleotide"
ggacgaaacaccggaaccattcaaaacagcatagcaagttaaaataaggctagtccgttatcaacttgaaaaagtggcaccgagtcggtgcttttttt

SEQ ID NO: 1628 - DNA, 186 bp, Artificial Sequence
  source: /note="Description of Artificial Sequence: Synthetic polynucleotide"
ggacgaaacaccggtagtattaagtattgttttatggctgataaatttctttgaatttctccttgattatttgttataaaagttataaaataatcttgttggaaccattcaaaacagcatagcaagttaaaataaggctagtccgttatcaacttgaaaaagtggcaccgagtcggtgcttttttt

SEQ ID NO: 1629 - DNA, 95 bp, Artificial Sequence
  source: /note="Description of Artificial Sequence: Synthetic oligonucleotide"
gggttttagagctatgctgttttgaatggtcccaaaacgggtcttcgagaagacgttttagagctatgctgttttgaatggtcccaaaacttttt

SEQ ID NO: 1630 - DNA, 36 bp, Artificial Sequence
  source: /note="Description of Artificial Sequence: Synthetic oligonucleotide"
  modified_base (5)..(34): a, c, t, g, unknown or other
aaacnnnnnnnnnnnnnnnnnnnnnnnnnnnnnngt

SEQ ID NO: 1631 - DNA, 36 bp, Artificial Sequence
  source: /note="Description of Artificial Sequence: Synthetic oligonucleotide"
  modified_base (7)..(36): a, c, t, g, unknown or other
taaaacnnnnnnnnnnnnnnnnnnnnnnnnnnnnnn

SEQ ID NO: 1632 - DNA, 84 bp, Artificial Sequence
  source: /note="Description of Artificial Sequence: Synthetic oligonucleotide"
gtggaaaggacgaaacaccgggtcttcgagaagacctgttttagagctagaaatagcaagttaaaataaggctagtccgttttt

SEQ ID NO: 1633 - RNA, 46 nt, Artificial Sequence
  source: /note="Description of Artificial Sequence: Synthetic oligonucleotide"
  modified_base (1)..(19): a, c, u, g, unknown or other
nnnnnnnnnnnnnnnnnnnguuauuguacucucaagauuuauuuuu

SEQ ID NO: 1634 - RNA, 91 nt, Artificial Sequence
  source: /note="Description of Artificial Sequence: Synthetic oligonucleotide"
guuacuuaaaucuugcagaagcuacaaagauaaggcuucaugccgaaaucaacacccugucauuuuauggcaggguguuuucguuauuuaa

SEQ ID NO: 1635 - DNA, 70 bp, Homo sapiens
ttttctagtgctgagtttctgtgactcctctacattctacttctctgtgtttctgtatactacctcctcc

SEQ ID NO: 1636 - DNA, 122 bp, Homo sapiens
ggaggaagggcctgagtccgagcagaagaagaagggctcccatcacatcaaccggtggcgcattgccacgaagcaggccaatggggaggacatcgatgtcacctccaatgactagggtgggc

SEQ ID NO: 1637 - RNA, 48 nt, Artificial Sequence
  source: /note="Description of Artificial Sequence: Synthetic oligonucleotide"
  modified_base (3)..(32): a, c, u, g, unknown or other
acnnnnnnnnnnnnnnnnnnnnnnnnnnnnnnguuuuagagcuaugcu

SEQ ID NO: 1638 - DNA, 67 bp, Artificial Sequence
  source: /note="Description of Artificial Sequence: Synthetic oligonucleotide"
  source: /note="Description of Combined DNA/RNA Molecule: Synthetic oligonucleotide"
agcauagcaaguuaaaauaaggctaguccguuaucaacuugaaaaaguggcaccgagucggugcuuu

SEQ ID NO: 1639 - RNA, 62 nt, Artificial Sequence
  source: /note="Description of Artificial Sequence: Synthetic oligonucleotide"
  modified_base (1)..(20): a, c, u, g, unknown or other
nnnnnnnnnnnnnnnnnnnnguuuuagagcuagaaauagcaaguuaaaauaaggcuaguccg

SEQ ID NO: 1640 - DNA, 73 bp, Artificial Sequence
  source: /note="Description of Artificial Sequence: Synthetic oligonucleotide"
tgaatggtcccaaaacggaagggcctgagtccgagcagaagaagaagttttagagctatgctgttttgaatgg

SEQ ID NO: 1641 - DNA, 69 bp, Homo sapiens
ctggtcttccacctctctgccctgaacacccaatctcggcccctctcgccaccctcctgcatttctgtt

SEQ ID NO: 1642 - DNA, 138 bp, Mus musculus
acccaagcactgagtgccattagctaaatgcatagggtaccacccacaggtgccaggggcctttcccaaagttcccagccccttctccaacctttcctggcccagaggctttcccatgtgtgtggctggaccctttga

SEQ ID NO: 1643 - DNA, 21 bp, Artificial Sequence
  source: /note="Description of Artificial Sequence: Synthetic primer"
aaaaccacccttctctctggc

SEQ ID NO: 1644 - DNA, 21 bp, Artificial Sequence
  source: /note="Description of Artificial Sequence: Synthetic primer"
ggagattggagacacggagag

SEQ ID NO: 1645 - DNA, 20 bp, Artificial Sequence
  source: /note="Description of Artificial Sequence: Synthetic primer"
ctggaaagccaatgcctgac

SEQ ID NO: 1646 - DNA, 20 bp, Artificial Sequence
  source: /note="Description of Artificial Sequence: Synthetic primer"
ggcagcaaactccttgtcct

SEQ ID NO: 1647 - DNA, 20 bp, Artificial Sequence
  source: /note="Description of Artificial Sequence: Synthetic primer"
gtgctttgcagaggcctacc

SEQ ID NO: 1648 - DNA, 20 bp, Artificial Sequence
  source: /note="Description of Artificial Sequence: Synthetic primer"
cctggagcgcatgcagtagt

SEQ ID NO: 1649 - DNA, 22 bp, Artificial Sequence
  source: /note="Description of Artificial Sequence: Synthetic primer"
accttctgtgtttccaccattc

SEQ ID NO: 1650 - DNA, 20 bp, Artificial Sequence
  source: /note="Description of Artificial Sequence: Synthetic primer"
ttggggagtgcacagacttc

SEQ ID NO: 1651 - DNA, 30 bp, Artificial Sequence
  source: /note="Description of Artificial Sequence: Synthetic probe"
tagctctaaaacttcttcttctgctcggac

SEQ ID NO: 1652 - DNA, 30 bp, Artificial Sequence
  source: /note="Description of Artificial Sequence: Synthetic probe"
ctagccttattttaacttgctatgctgttt

SEQ ID NO: 1653 - RNA, 99 nt, Artificial Sequence
  source: /note="Description of Artificial Sequence: Synthetic oligonucleotide"
  modified_base (1)..(20): a, c, u, g, unknown or other
nnnnnnnnnnnnnnnnnnnnguuuuagagcuagaaauagcaaguuaaaauaaggcuaguccguuaucaacuugaaaaaguggcaccgagucggugcuuu

SEQ ID NO: 1654 - DNA, 12 bp, Homo sapiens
tagcgggtaagc

SEQ ID NO: 1655 - DNA, 12 bp, Homo sapiens
tcggtgacatgt

SEQ ID NO: 1656 - DNA, 12 bp, Homo sapiens
actccccgtagg

SEQ ID NO: 1657 - DNA, 12 bp, Homo sapiens
actgcgtgttaa

SEQ ID NO: 1658 - DNA, 12 bp, Homo sapiens
acgtcgcctgat

SEQ ID NO: 1659 - DNA, 12 bp, Homo sapiens
taggtcgaccag

SEQ ID NO: 1660 - DNA, 12 bp, Homo sapiens
ggcgttaatgat

SEQ ID NO: 1661 - DNA, 12 bp, Homo sapiens
tgtcgcatgtta

SEQ ID NO: 1662 - DNA, 12 bp, Homo sapiens
atggaaacgcat

SEQ ID NO: 1663 - DNA, 12 bp, Homo sapiens
gccgaattcctc

SEQ ID NO: 1664 - DNA, 12 bp, Homo sapiens
gcatggtacgga

SEQ ID NO: 1665 - DNA, 12 bp, Homo sapiens
cggtactcttac

SEQ ID NO: 1666 - DNA, 12 bp, Homo sapiens
gcctgtgccgta

SEQ ID NO: 1667 - DNA, 12 bp, Homo sapiens
tacggtaagtcg

SEQ ID NO: 1668 - DNA, 12 bp, Homo sapiens
cacgaaattacc

SEQ ID NO: 1669 - DNA, 12 bp, Homo sapiens
aaccaagatacg

SEQ ID NO: 1670 - DNA, 12 bp, Homo sapiens
gagtcgatacgc

SEQ ID NO: 1671 - DNA, 12 bp, Homo sapiens
gtctcacgatcg

SEQ ID NO: 1672 - DNA, 12 bp, Homo sapiens
tcgtcgggtgca

SEQ ID NO: 1673 - DNA, 12 bp, Homo sapiens
actccgtagtga

SEQ ID NO: 1674 - DNA, 12 bp, Homo sapiens
caggacgtccgt

SEQ ID NO: 1675 - DNA, 12 bp, Homo sapiens
tcgtatccctac

SEQ ID NO: 1676 - DNA, 12 bp, Homo sapiens
tttcaaggccgg

SEQ ID NO: 1677 - DNA, 12 bp, Homo sapiens
cgccggtggaat

SEQ ID NO: 1678 - DNA, 12 bp, Homo sapiens
gaacccgtccta

SEQ ID NO: 1679 - DNA, 12 bp, Homo sapiens
gattcatcagcg

SEQ ID NO: 1680 - DNA, 12 bp, Homo sapiens
acaccggtcttc

SEQ ID NO: 1681 - DNA, 12 bp, Homo sapiens
atcgtgccctaa

SEQ ID NO: 1682 - DNA, 12 bp, Homo sapiens
gcgtcaatgttc

SEQ ID NO: 1683 - DNA, 12 bp, Homo sapiens
ctccgtatctcg

SEQ ID NO: 1684 - DNA, 12 bp, Homo sapiens
ccgattccttcg

SEQ ID NO: 1685 - DNA, 12 bp, Homo sapiens
tgcgcctccagt

SEQ ID NO: 1686 - DNA, 12 bp, Homo sapiens
taacgtcggagc

SEQ ID NO: 1687 - DNA, 12 bp, Homo sapiens
aaggtcgcccat

SEQ ID NO: 1688 - DNA, 12 bp, Homo sapiens
gtcggggactat

SEQ ID NO: 1689 - DNA, 12 bp, Homo sapiens
ttcgagcgattt

SEQ ID NO: 1690 - DNA, 12 bp, Homo sapiens
tgagtcgtcgag

SEQ ID NO: 1691 - DNA, 12 bp, Homo sapiens
tttacgcagagg

SEQ ID NO: 1692 - DNA, 12 bp, Homo sapiens
aggaagtatcgc

SEQ ID NO: 1693 - DNA, 12 bp, Homo sapiens
actcgataccat

SEQ ID NO: 1694 - DNA, 12 bp, Homo sapiens
cgctacatagca

SEQ ID NO: 1695 - DNA, 12 bp, Homo sapiens
ttcataaccggc

SEQ ID NO: 1696 - DNA, 12 bp, Homo sapiens
ccaaacggttaa

SEQ ID NO: 1697 - DNA, 12 bp, Homo sapiens
cgattccttcgt

SEQ ID NO: 1698 - DNA, 12 bp, Homo sapiens
cgtcatgaataa

SEQ ID NO: 1699 - DNA, 12 bp, Homo sapiens
agtggcgatgac

SEQ ID NO: 1700 - DNA, 12 bp, Homo sapiens
cccctacggcac

SEQ ID NO: 1701 - DNA, 12 bp, Homo sapiens
gccaacccgcac

SEQ ID NO: 1702 - DNA, 12 bp, Homo sapiens
tgggacaccggt

SEQ ID NO: 1703 - DNA, 12 bp, Homo sapiens
ttgactgcggcg

SEQ ID NO: 1704 - DNA, 12 bp, Homo sapiens
actatgcgtagg

SEQ ID NO: 1705 - DNA, 12 bp, Homo sapiens
tcacccaaagcg

SEQ ID NO: 1706 - DNA, 12 bp, Homo sapiens
gcaggacgtccg

SEQ ID NO: 1707 - DNA, 12 bp, Homo sapiens
acaccgaaaacg

SEQ ID NO: 1708 - DNA, 12 bp, Homo sapiens
cggtgtattgag

SEQ ID NO: 1709 - DNA, 12 bp, Homo sapiens
cacgaggtatgc

SEQ ID NO: 1710 - DNA, 12 bp, Homo sapiens
taaagcgacccg

SEQ ID NO: 1711 - DNA, 12 bp, Homo sapiens
cttagtcggcca

SEQ ID NO: 1712 - DNA, 12 bp, Homo sapiens
cgaaaacgtggc

SEQ ID NO: 1713 - DNA, 12 bp, Homo sapiens
cgtgccctgaac

SEQ ID NO: 1714 - DNA, 12 bp, Homo sapiens
tttaccatcgaa

SEQ ID NO: 1715 - DNA, 12 bp, Homo sapiens
cgtagccatgtt

SEQ ID NO: 1716 - DNA, 12 bp, Homo sapiens
cccaaacggtta

SEQ ID NO: 1717 - DNA, 12 bp, Homo sapiens
gcgttatcagaa

SEQ ID NO: 1718 - DNA, 12 bp, Homo sapiens
tcgatggtaaac

SEQ ID NO: 1719 - DNA, 12 bp, Homo sapiens
cgactttttgca

SEQ ID NO: 1720 - DNA, 12 bp, Homo sapiens
tcgacgactcac

SEQ ID NO: 1721 - DNA, 12 bp, Homo sapiens
acgcgtcagata

SEQ ID NO: 1722 - DNA, 12 bp, Homo sapiens
cgtacggcacag

SEQ ID NO: 1723 - DNA, 12 bp, Homo sapiens
ctatgccgtgca

SEQ ID NO: 1724 - DNA, 12 bp, Homo sapiens
cgcgtcagatat

SEQ ID NO: 1725 - DNA, 12 bp, Homo sapiens
aagatcggtagc

SEQ ID NO: 1726 - DNA, 12 bp, Homo sapiens
cttcgcaaggag

SEQ ID NO: 1727 - DNA, 12 bp, Homo sapiens
gtcgtggactac

SEQ ID NO: 1728 - DNA, 12 bp, Homo sapiens
ggtcgtcatcaa

SEQ ID NO: 1729 - DNA, 12 bp, Homo sapiens
gttaacagcgtg

SEQ ID NO: 1730 - DNA, 12 bp, Homo sapiens
tagctaaccgtt

SEQ ID NO: 1731 - DNA, 12 bp, Homo sapiens
agtaaaggcgct

SEQ ID NO: 1732 - DNA, 12 bp, Homo sapiens
ggtaatttcgtg

SEQ ID NO: 1733 - DNA, 15 bp, Artificial Sequence
  source: /note="Description of Artificial Sequence: Synthetic oligonucleotide"
cagaagaagaagggc

SEQ ID NO: 1734 - DNA, 51 bp, Artificial Sequence
  source: /note="Description of Artificial Sequence: Synthetic oligonucleotide"
ccaatggggaggacatcgatgtcacctccaatgactagggtggtgggcaac

SEQ ID NO: 1735 - DNA, 15 bp, Artificial Sequence
  source: /note="Description of Artificial Sequence: Synthetic oligonucleotide"
ctctggccactccct

SEQ ID NO: 1736 - DNA, 52 bp, Artificial Sequence
  source: /note="Description of Artificial Sequence: Synthetic oligonucleotide"
acatcgatgtcacctccaatgacaagcttgctagcggtgggcaaccacaaac

SEQ ID NO: 1737 - DNA, 25 bp, Artificial Sequence
  source: /note="Description of Artificial Sequence: Synthetic oligonucleotide"
  modified_base (6)..(25): a, c, t, g, unknown or other
caccgnnnnnnnnnnnnnnnnnnnn

SEQ ID NO: 1738 - DNA, 25 bp, Artificial Sequence
  source: /note="Description of Artificial Sequence: Synthetic oligonucleotide"
  modified_base (5)..(24): a, c, t, g, unknown or other
aaacnnnnnnnnnnnnnnnnnnnnc

SEQ ID NO: 1739 - DNA, 54 bp, Artificial Sequence
  source: /note="Description of Artificial Sequence: Synthetic oligonucleotide"
aacaccgggtcttcgagaagacctgttttagagctagaaatagcaagttaaaat

SEQ ID NO: 1740 - DNA, 54 bp, Artificial Sequence
  source: /note="Description of Artificial Sequence: Synthetic oligonucleotide"
caaaacgggtcttcgagaagacgttttagagctatgctgttttgaatggtccca

SEQ ID NO: 1741 - DNA, 4104 bp, Homo sapiens
  CDS (1)..(4104)
atggacaagaagtacagcatcggcctggacatcggcaccaactctgtgggctgggccgtgatcaccgacgagtacaaggtgcccagcaagaaattcaaggtgctgggcaacaccgaccggcacagcatcaagaagaacctgatcggagccctgctgttcgacagcggcgaaacagccgaggccacccggctgaagagaaccgccagaagaagatacaccagacggaagaaccggatctgctatctgcaagagatcttcagcaacgagatggccaaggtggacgacagcttcttccacagactggaagagtccttcctggtggaagaggataagaagcacgagcggcaccccatcttcggcaacatcgtggacgaggtggcctaccacgagaagtaccccaccatctaccacctgagaaagaaactggtggacagcaccgacaaggccgacctgcggctgatctatctggccctggcccacatgatcaagttccggggccacttcctgatcgagggcgacctgaaccccgacaacagcgacgtggacaagctgttcatccagctggtgcagacctacaaccagctgttcgaggaaaaccccatcaacgccagcggcgtggacgccaaggccatcctgtctgccagactgagcaagagcagacggctggaaaatctgatcgcccagctgcccggcgagaagaagaatggcctgttcggcaacctgattgccctgagcctgggcctgacccccaacttcaagagcaacttcgacctggccgaggatgccaaactgcagctgagcaaggacacctacgacgacgacctggacaacctgctggcccagatcggcgaccagtacgccgacctgtttctggccgccaagaacctgtccgacgccatcctgctgagcgacatcctgagagtgaacaccgagatcaccaaggcccccctgagcgcctctatgatcaagagatacgacgagcaccaccaggacctgaccctgctgaaagctctcgtgcggcagcagctgcctgagaagtacaaagagattttcttcgaccagagcaagaacggctacgccggctacattgacggcggagccagccaggaagagttctacaagttcatcaagcccatcctggaaaagatggacggcaccgaggaactgctcgtgaagctgaacagagaggacctgctgcggaagcagcggaccttcgacaacggcagcatcccccaccagatccacctgggagagctgcacgccattctgcggcggcaggaagatttttacccattcctgaaggacaaccgggaaaagatcgagaagatcctgaccttccgcatcccctactacgtgggccctctggccaggggaaacagcagattcgcctggatgaccagaaagagcgaggaaaccatcaccccctggaacttcgaggaagtggtggacaagggcgcttccgcccagagcttcatcgagcggatgaccaacttcgataagaacctgcccaacgagaaggtgctgcccaagcacagcctgctgtacgagtacttcaccgtgtataacgagctgaccaaagtgaaatacgtgaccgagggaatgagaaagcccgccttcctgagcggcgagcagaaaaaggccatcgtggacctgctgttcaagaccaaccggaaagtgaccgtgaagcagctgaaagaggactacttcaagaaaatcgagtgcttcgactccgtggaaatctccggcgtggaagatcggttcaacgcctccctgggcacataccacgatctgctgaaaattatcaaggacaaggacttcctggacaatgaggaaaacgaggacattctggaagatatcgtgctgaccctgacactgtttgaggacagagagatgatcgaggaacggctgaaaacctatgcccacctgttcgacgacaaagtgatgaagcagctgaagcggcggagatacaccggctggggcaggctgagccggaagctgatcaacggcatccgggacaagcagtccggcaagacaatcctggatttcctgaagtccgacggcttcgccaacagaaacttcatgcagctgatccacgacgacagcctgacctttaaagaggacatccagaaagcccaggtgtccggccagggcgatagcctgcacgagcacattgccaatctggccggcagccccgccattaagaagggcatcctgcagacagtgaaggtggtggacgagctcgtgaaagtgatgggccggcacaagcccgagaacatcgtgatcgccatggccagagagaaccagaccacccagaagggacagaagaacagccgcgagagaatgaagcggatcgaagagggcatcaaagagctgggcagccagatcctgaaagaacaccccgtggaaaacacccagctgcagaacgagaagctgtacctgtactacctgcagaatgggcgggatatgtacgtggaccaggaactggacatcaaccggctgtccgactacgatgtggacgccatcgtgcctcagagctttctgaaggacgactccatcgacgccaaggtgctgaccagaagcgacaaggcccggggcaagagcgacaacgtgccctccgaagaggtcgtgaagaagatgaagaactactggcggcagctgctgaacgccaagctgattacccagagaaagttcgacaatctgaccaaggccgagagaggcggcctgagcgaactggataaggccggcttcatcaagagacagctggtggaaacccggcagatcacaaagcacgtggcacagatcctggactcccggatgaacactaagtacgacgagaatgacaagctgatccgggaagtgaaagtgatcaccctgaagtccaagctggtgtccgatttccggaaggatttccagttttacaaagtgcgcgagatcaacaactaccaccacgcccacgccgcctacctgaacgccgtcgtgggaaccgccctgatcaaaaagtaccctaagctggaaagcgagttcgtgtacggcgactacaaggtgtacgacgtgcggaagatgatcgccaagagcgagcaggaaatcggcaaggctaccgccaagtacttcttctacagcaacatcatgaactttttcaagaccgagattaccctggccaacggcgagatccggaagcggcctctgatcgagacaaacggcgaaaccggggagatcgtgtgggataagggccgggattttgccaccgtgcggaaagtgctgagcatgccccaagtgaatatcgtgaaaaagaccgaggtgcagacaggcggcttcagcaaagagtctatcctgcccaagaggaacagcgataagctgatcgccagaaagaaggactgggaccctaagaagtacggcggcttcgacagccccaccgtggcctattctgtgctggtggtggccaaagtggaaaagggcaagtccaagaaactgaagagtgtgaaagagctgctggggatcaccatcatggaaagaagcagcttcgagaagaatcccatcgactttctggaagccaagggctacaaagaagtgaaaaaggacctgatcatcaagctgcctaagtactccctgttcgagctggaaaacggccggaagagaatgctggcctctgccggcgaactgcagaagggaaacgaactggccctgccctccaaatatgtgaacttcctgtacctggccagccactatgagaagctgaagggctcccccgaggataatgagcagaaacagctgtttgtggaacagcacaagcactacctggacgagatcatcgagcagatcagcgagttctccaagagagtgatcctggccgacgctaatctggacaaagtgctgtccgcctacaacaagcaccgggataagcccatcagagagcaggccgagaatatcatccacctgtttaccctgaccaatctgggagcccctgccgccttcaagtactttgacaccaccatcgaccggaagaggtacaccagcaccaaagaggtgctggacgccaccctgatccaccagagcatcaccggcctgtacgagacacggatcgacctgtctcagctgggaggcgac

SEQ ID NO: 1742 - protein, 1368 aa, Homo sapiens
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIAMARENQTTQKGQKNSRERMKRIEEGIKELGSQILKEHPVENTQLQNEKLYLYYLQNGRDMYVDQELDINRLSDYDVDAIVPQSFLKDDSIDAKVLTRSDKARGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHAAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 1743 - DNA, 57 bp, Homo sapiens
  CDS (1)..(57)
ggcaccattaaagaaaatatcattggtgtttcctatgatgaatatagatacagaagc

SEQ ID NO: 1744 - protein, 19 aa, Homo sapiens
GTIKENIIGVSYDEYRYRS

SEQ ID NO: 1745 - DNA, 48 bp, Artificial Sequence
  source: /note="Description of Artificial Sequence: Synthetic oligonucleotide"
  CDS (1)..(48)
attaaagaaaatatcattggctttgtttcctatgatgaatatagatac

SEQ ID NO: 1746 - protein, 16 aa, Artificial Sequence
  source: /note="Description of Artificial Sequence: Synthetic peptide"
IKENIIGFVSYDEYRY

SEQ ID NO: 1747 - protein, 15 aa, Artificial Sequence
  Description of Artificial Sequence: Synthetic peptide
GGGGSGGGGSGGGGS

SEQ ID NO: 1748 - protein, 15 aa, Artificial Sequence
  Description of Artificial Sequence: Synthetic peptide
EAAAKEAAAKEAAAK

SEQ ID NO: 1749 - protein, 18 aa, Artificial Sequence
  Description of Artificial Sequence: Synthetic peptide
GGGGGSGGGGGSGGGGGS

SEQ ID NO: 1750 - DNA, 19 bp, Artificial Sequence
  source: /note="Description of Artificial Sequence: Synthetic oligonucleotide"
gggcgcacctctctttacg

What is claimed is:

1. A method of treating a hepatitis B virus (HBV) infection, comprising administering an effective amount of a CRISPR-Cas system to a mammal, wherein the CRISPR-Cas system comprises
  (i) a CRISPR protein or a polynucleotide encoding a CRISPR protein, and
  (ii) two or more CRISPR-Cas system polynucleotides each targeting a different target HBV sequence comprised both in an HBV covalently closed circular DNA cccDNA) and in an HBV DNA integrated into the genome of a liver cell wherein the CRISPR-Cas system polynucleotides each comprising:
    (a) a guide sequence capable of hybridizing to the target HBV sequence,
    (b) a tracr mate sequence capable of hybridizing to a tracr sequence, and
    (c) a tracr sequence,
wherein each of the CRISPR-Cas system polynucleotides forms a CRISPR complex with the CRISPR protein in the liver cell and directs sequence-specific binding of the CRISPR complex to the target HBV sequence both in the HBV cccDNA and in the HBV DNA integrated into the genome of liver cell, thereby reducing HBsAg, serum HBV DNA and HBV RNA in vivo in the mammal.

2. The method of claim 1, further comprising administering an additional HBV treatment to the mammal.

3. The method of claim 2, wherein the additional treatment comprises an epigenetic modifier.

4. The method of claim 1, wherein the CRISPR protein and/or the CRISPR-Cas system polynucleotides are encoded or comprised within a vector system comprising one or more vectors.

5. The method of claim 4, wherein the one or more vectors comprise one or more viral vectors.

6. The method of claim 5, wherein the one or more viral vectors comprise one or more lentiviral, adenoviral or adeno-associated viral (AAV) vectors.

7. The method of claim 4, wherein the CRISPR protein and the CRISPR-Cas system polynucleotides are encoded in a single vector.

8. The method of claim 1, wherein each of the CRISPR-Cas system polynucleotides is a chimeric RNA (chiRNA).

9. The method of claim 1, wherein the CRISPR protein is a nuclease.

10. The method of claim 1, wherein the CRISPR protein comprises one or more mutations in atleast one catalytic domain.

11. The method of claim 1, wherein the CRISPR protein further comprises two or more nuclear localization sequences (NLSs).

12. The method of claim 1, wherein the CRISPR protein comprises one or more mutations in at least one catalytic domain, and wherein the CRISPR protein is fused to a heterologous functional domain.

13. The method of claim 12, wherein the heterologous functional domain is a transcriptional activator, a transcriptional repressor, a recombinase, a transposase, a histone remodeler, a demethylase, or a DNA methyltransferase.

14. The method of claim 13, wherein the heterologous functional domain is VP64, SID4x, or KRAB.

15. The method of claim 1, wherein the CRISPR protein further comprises one or more nuclear localization sequences (NLSs) capable of driving the accumulation of the CRISPR protein to a detectible amount in the nucleus of the liver cell.

16. The method of claim 15, wherein the CRISPR protein comprises at least one NLS at or near the amino-terminus of the CRISPR protein and/or at least one NLS at or near the carboxy-terminus the CRISPR protein.

17. The method of claim 1, wherein the CRISPR-Cas system is comprised in a liposome or a lipid particle.

18. The method of claim 1, wherein the CRISPR protein is Cas9.

19. The method of claim 18, wherein the CRISPR protein is *Staphylococcus aureus* Cas9.

20. The method of claim 18, wherein the CRISPR protein is *Streptococcus pyogenes* Cas9.

21. The method of claim 1, wherein the mammal is a human subject.

22. The method of claim 1, wherein the CRISPR-Cas system comprises at least three CRISPR-Cas system polynucleotides each targeting a different target HBV sequence.

* * * * *